US011439072B2

(12) United States Patent
Van Der Hulst et al.

(10) Patent No.: US 11,439,072 B2
(45) Date of Patent: Sep. 13, 2022

(54) SEX DETERMINATION GENES AND THEIR USE IN BREEDING

(71) Applicant: Limgroup B.V., Horst (NL)

(72) Inventors: Ronaldus Gerardus Maria Van Der Hulst, Horst (NL); Paolo Riccardi, Horst (NL); Johannes Simon Groenendijk, Horst (NL); Agostino Falavigna, Horst (NL)

(73) Assignee: Limgroup B.V., Horst (NL)

( * ) Notice: Subject to any disclaimer, the term of this patent is extended or adjusted under 35 U.S.C. 154(b) by 775 days.

(21) Appl. No.: 15/541,188

(22) PCT Filed: Jan. 10, 2016

(86) PCT No.: PCT/IB2016/000031
§ 371 (c)(1),
(2) Date: Jun. 30, 2017

(87) PCT Pub. No.: WO2016/110780
PCT Pub. Date: Jul. 14, 2016

(65) Prior Publication Data

US 2017/0347549 A1 Dec. 7, 2017

(30) Foreign Application Priority Data

Jan. 9, 2015 (NL) ..................................... 2014107

(51) Int. Cl.

| | |
|---|---|
| ***A01H 1/02*** | (2006.01) |
| ***A01H 5/04*** | (2018.01) |
| ***C07K 14/415*** | (2006.01) |
| ***C12N 15/82*** | (2006.01) |
| ***A01H 1/04*** | (2006.01) |
| ***A01H 1/06*** | (2006.01) |
| ***A01H 6/12*** | (2018.01) |

(52) U.S. Cl.
CPC ................. *A01H 1/02* (2013.01); *A01H 1/04* (2013.01); *A01H 1/06* (2013.01); *A01H 5/04* (2013.01); *A01H 6/12* (2018.05); *C07K 14/415* (2013.01); *C12N 15/8287* (2013.01)

(58) Field of Classification Search
None
See application file for complete search history.

(56) References Cited

FOREIGN PATENT DOCUMENTS

| | | |
|---|---|---|
| CN | 101263783 | 9/2008 |
| JP | 2005-73521 | 3/2005 |
| WO | WO-2013/027659 | 2/2013 |
| WO | WO-2014/152447 | 9/2014 |

OTHER PUBLICATIONS

Matsunaga et al (2001, "sex determination by sex chromosomes in dioecious plants", Plant Biology 3 (5): 481-488).*

Donnison et al (1996, "Isolation of Y Chromosome-Specific Sequences from Silene latifolia and Mapping of Male Sex-Determining Genes Using Representational Difference Analysis", Genetics 144:1893-1901).*

Emery et al (2003, "Radial Patterning of *Arabidopsis* Shoots by Class III HD-ZIP and KANADI Genes", Current Biology 13:1768-1774).*

Harkess et al (Nov. 2, 2017, "The Asparagus Genome Sheds Light on the Origin and Evolution of a Young Y Chromosome", Nature Communications 8:1279).*

Ellis, Mary Ellen, 2018, www.gardeningknowhow.com/garden-how-to/info/dioecious-monoecious-information.htm; This article was last updated on Apr. 3, 2018.*

Protein: W9SPC1_9ROSA (W9SPC1), pfam.xfam.org/protein/W9SPC1_9ROSA, May 14, 2014 (Year: 2014).*

Harkess et al., The asparagus genome sheds light on the origin and evolution of a young Y chromosome, Nature Communications, 2017, 8:1279 (Year: 2017).*

Donnison, Isolation of Y Chromosome-Specific Sequences from Silene latifolia and Mapping of Male Sex-Determining Genes Using Representational Difference Analysis, Genetics, 1996, 144:1893-1901 (Year: 1996).*

Gao et al., "Comparative Analysis of Gene Expression by Microarray Analysis of Male and Female Flowers of *Asparagus officinalis*," Biosci. Biotechnol. Biochem. (2013) 77(6):1193-1199.

International Search Report for PCT/IB2016/000031, dated Jul. 15, 2016, 4 pages.

Matsunaga and Kawano, "Sex Determination by Sex Chromosomes in Dioecious Plants," Plant biol. (2001) 3:481-488.

Riccardi et al., "Genetic characterization of asparagus doubled haploids collection and wild relatives," Scientia Horticulturae (2011) 130:691-700.

Telgmann-Rauber et al., "Genetic and physical maps around the sex-determining M-locus of the dioecious plant asparagus," Mol. Genet. Genomics (2007) 278:221-234.

Zhu et al., "*Defective in Tapetai Development and Function 1* is essential for another development and tapetal function for microspore maturation in *Arabidopsis*," The Plant Journal (2008) 55:266-277.

Riccardi et al., "Sex Inheritance in Asparagus: a Hermaphrodite Doubled Haploid Line Confirms an Old Theory?," Proceedings of the 54th Italian Society of Agricultural Genetics Annual Congress, Matera, Italy, Sep. 27/30, 2010, 2 pages.

(Continued)

*Primary Examiner* — Weihua Fan
*Assistant Examiner* — Brian James Sullivan
(74) *Attorney, Agent, or Firm* — Morrison & Foerster LLP

(57) ABSTRACT

The invention relates to a method to improve breeding in dioecious plants, preferably *Asparagus* plants, comprising providing a plant in which the functional expression of the dominant suppressor of gynoecium development is disrupted or reduced and introducing said plant in inbreeding, backcross breeding, recurrent backcross breeding or double haploid breeding techniques. Preferably said dominant suppressor of gynoecium development is a gene comprising a DUF247 domain. Also provided are dioeciuos plants in which the expression of this gene is disrupted or reduced.

10 Claims, 154 Drawing Sheets

Figure 1A:
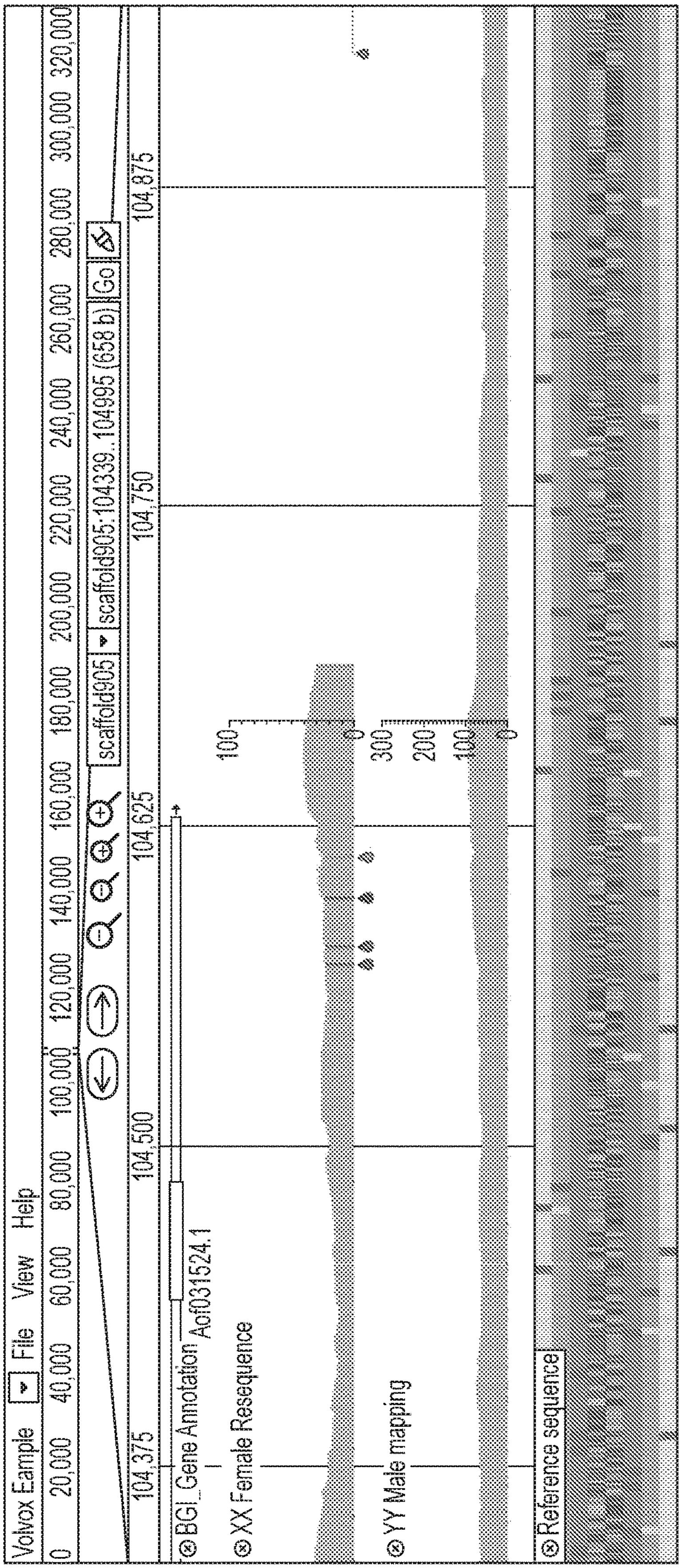

Specification includes a Sequence Listing.

(56) References Cited

OTHER PUBLICATIONS

Examination report for TW 105100663, dated Feb. 14, 2020, 15 pages.

Manzanares et al., "A gene encoding a DUF247 domain protein cosegregates with the S self-incompatibility locus in perennial ryegrass," Molecular Biology and Evolution (2015) 33(4):870-884.

Notification of Reasons for Rejection for JP 2017-554655, dated Feb. 4, 2020, 17 pages.

* cited by examiner

Fig. 3A cDNA' sequences

>scaffold M locus 4 cDNA including 3UTR inferred from RT-PCR results
ATGTCTGAAGCCTGGGTTTCTCGATTGACATCGGATATAGGGTGGCTCAATAGCACAAATGCCCTGATGGCGGAG
GCCTGGAGTCGTCATTCAATCTACGACGTACCAGACACATTCAAAAGGATTAGCCCACAGATCCATAAGCCATCA
ACGTGCAGCATTGGACCACGGTACAATGGAGATCTGAATCTCCTTCGTATGGAACGTCATAAACACAGGGCGCTA
CTGAACTTCCTCATCCGATGTCAAGTGTCGATCCATGACATCATACGAGCCCTGAGGAAGAACCTGCACGATTTC
AGAGCCTGCTATCAAGATCTTGACACCTTTTGGATGAAGAATGATGATGAGTTCCTAAAAATCATGATTTACGAT
GGGGCTTTCATGATTGAAATCATGATAGCGACCGTTGAACCATATGAGCGCACACCTTCTAGCTATCATGCCAAG
GACCCAATATTCAAGAAGCCATACTTGGTCGAAGATCTTCGTGTAGATATGCTCAGGTTGGATAATCAAATTCCA
ATGAAGGTCCTGGAGATATTGTCTAAATTCTGCAAGAACAAGATCCAAAGCATTCATCAGCTGATCAGACATTTC
TTCTTCCGCAAATATGAAGAGGGAAGATATGATATTAGCCAAACCTCTACGATATTTCACCTACCCGAGATAACA
GGGCATCACCTACTGGATGTGTACAAAAAAACTCTTATACAGCATGGAGGTTATCATCACACCAGCAGTCGCCAA
CCACTATCGGCAGTTGAACTACAGGAGGCGGGCGTAATTTTCCAGTGCAGTGAAACGCTGTCATTGACAGATATA
TGCTTCACCAAAGGTGTCCTTTGCCTACCTGCAGTCGACGTTGACGAAGCATTTGAAGTTGTTATGCGGAATCTC
ATTGCCTATGAGCAAGCACATGGCGAAGGTCAAGAGGTAACATCCTATGTGTTTTTTATGGATGGCATTGTAAAC
AATGACAAAGATATTGCCTTGCTTCGAGAGAAGGGTATTATCAGGTCGGGGGTAAGCAGTGATAAGAGGATAGCC
GATCTTTTTAATGGACTGACAAAAGGTATAGTTGCAAAAGTTGTCGACAATGTTGATGTTGATGTAACCAAGGAC
ATCAATGAGTATTGCAATAGAAGATGGAACAGGTGGCAAGCCAACTTTAAGCAGAGATACTTTGCGAATCCATGG
GCCTTTCCCGGGATTCATAAATGTTGATCTCAACGGTAGGGTTTCGTGCTGGGGTTTGAGTATCTGTGGAGCATT
TAGTGTGAGAAAACTGTGCTTAATTTCGCTTCTCCACTATGAGAGTGGAGGAGCACAACTAATGGTATCCAGTGT
AAATTTAACTCTTTGTTTGTGGCTTGAGAACAACATGTTCTTTATATAGCCTTTGACAATGTAATAGATAACATC
AACTTCTTTGATACATACTAGCGATATTAGCATCCAAAAAAAAAA >scaffold M locus 4 cDNA start to stop inferred by EVM1
ATGTCTGAAGCCTGGGTTTCTCGATTGACATCGGATATAGGGTGGCTCAATAGCACAAATGCCCTGAT
GGCGGAGGCCTGGAGTCGTCATTCAATCTACGACGTACCAGACACATTCAAAAGGATTAGCCCACAGA
TCCATAAGCCATCAACGTGCAGCATTGGACCACGGTACAATGGAGATCTGAATCTCCTTCGTATGGAA
CGTCATAAACACAGGGCGCTACTGAACTTCCTCATCCGATGTCAAGTGTCGATCCATGACATCATACG
AGCCCTGAGGAAGAACCTGCACGATTTCAGAGCCTGCTATCAAGATCTTGACACCTTTTGGATGAAGA
ATGATGATGAGTTCCTAAAAATCATGATTTACGATGGGGCTTTCATGATTGAAATCATGATAGCGACC
GTTGAACCATATGAGCGCACACCTTCTAGCTATCATGCCAAGGACCCAATATTCAAGAAGCCATACTT
GGTCGAAGATCTTCGTGTAGATATGCTCAGGTTGGATAATCAAATTCCAATGAAGGTCCTGGAGATAT
TGTCTAAATTCTGCAAGAACAAGATCCAAAGCATTCATCAGCTGATCAGACATTTCTTCTTCCGCAAA
TATGAAGAGGGAAGATATGATATTAGCCAAACCTCTACGATATTTCACCTACCCGAGATAACAGGGCA
TCACCTACTGGATGTGTACAAAAAAACTCTTATACAGCATGGAGGTTATCATCACACCAGCAGTCGCC
AACCACTATCGGCAGTTGAACTACAGGAGGCGGGCGTAATTTTCCAGTGCAGTGAAACGCTGTCATTG
ACAGATATATGCTTCACCAAAGGTGTCCTTTGCCTACCTGCAGTCGACGTTGACGAAGCATTTGAAGT
TGTTATGCGGAATCTCATTGCCTATGAGCAAGCACATGGCGAAGGTCAAGAGGTAACATCCTATGTGT
TTTTTATGGATGGCATTGTAAACAATGACAAAGATATTGCCTTGCTTCGAGAGAAGGGTATTATCAGG
TCGGGGGTAAGCAGTGATAAGAGGATAGCCGATCTTTTTAATGGACTGACAAAAGGTATAGTTGCAAA
AGTTGTCGACAATGTTGATGTTGATGTAACCAAGGACATCAATGAGTATTGCAATAGAAGATGGAACA
GGTGGCCTTTCCCGGGATTCATAAATGTTGATCTCAACGGTAGGGTTTCGTGCTGGGGTTTGAGTATC
TGTGGAGCATTTAGTGTGAGAAAACTGTGCTTAATTTCGCTTCTCCACTATGAGAGTGGAGGAGCACA
ACTAATGGTATCCAGTGTAAATTTAACTCTTTGTTTGTGGCTTGAGAACAACATGTTCTTTATATAG >scaffold M locus 4 cDNA start to stop inferred by FGENESH
ATGTCTGAAGCCTGGGTTTCTCGATTGACATCGGATATAGGGTGGCTCAATAGCACAAATGCCCTGATGGCGGAG
GCCTGGAGTCGTCATTCAATCTACGACGTACCAGACACATTCAAAAGGATTAGCCCACAGATCCATAAGCCATCA
ACGTGCAGCATTGGACCACGGTACAATGGAGATCTGAATCTCCTTCGTATGGAACGTCATAAACACAGGGCGCTA
CTGAACTTCCTCATCCGATGTCAAGTGTCGATCCATGACATCATACGAGCCCTGAGGAAGAACCTGCACGATTTC
AGAGCCTGCTATCAAGATCTTGACACCTTTTGGATGAAGAATGATGATGAGTTCCTAAAAATCATGATTTACGAT
GGGGCTTTCATGATTGAAATCATGATAGCGACCGTTGAACCATATGAGCGCACACCTTCTAGCTATCATGCCAAG
GACCCAATATTCAAGAAGCCATACTTGGTCGAAGATCTTCGTGTAGATATGCTCAGGTTGGATAATCAAATTCCA

Fig. 3B

ATGAAGGTCCTGGAGATATTGTCTAAATTCTGCAAGAACAAGATCCAAAGCATTCATCAGCTGATCAGACATTTC
TTCTTCCGCAAATATGAAGAGGGAAGATATGATATTAGCCAAACCTCTACGATATTTCACCTACCCGAGATAACA
GGGCATCACCTACTGGATGTGTACAAAAAAACTCTTATACAGCATGGAGGTTATCATCACACCAGCAGTCGCCAA
CCACTATCGGCAGTTGAACTACAGGAGGCGGGCGTAATTTTCCAGTGCAGTGAAACGCTGTCATTGACAGATATA
TGCTTCACCAAAGGTGTCCTTTGCCTACCTGCAGTCGACGTTGACGAAGCATTTGAAGTTGTTATGCGGAATCTC
ATTGCCTATGAGCAAGCACATGGCGAAGGTCAAGAGGTAACATCCTATGTGTTTTTTATGGATGGCATTGTAAAC
AATGACAAAGATATTGCCTTGCTTCGAGAGAAGGGTATTATCAGGTCGGGGGTAAGCAGTGATAAGAGGATAGCC
GATCTTTTTAATGGACTGACAAAAGGTATAGTTGCAAAAGTTGTCGACAATGTTGATGTTGATGTAACCAAGGAC
ATCAATGAGTATTGCAATAGAAGATGGAACAGGTGGCAAGCCAACTTTAAGCAGAGATACTTTGCGAATCCATGG
GTAACTTGCTCACTCATTGTAGGAGCTCTAGTATTAGGTCTCACCATCACTCAAACAATCTATGGCATCCTTTCT
TATAATAAGTGTAGTTAAT

>Scaffold3098 cDNA start to stop inferred from RT PCR result
obtained for the Mlocus4 DUF247 gene
ATGTCTGAAACCTGGGTTTCTCGATTGATATCGGATATAGAGTGGCTCAATAGCAGAAATGCCCTGAT
GGCAGACGCCTGGAGTCGTCATTCCATCTACACCGTCCCGGACACATTCAGAAGGATTAGCCCACAGA
TCCATAAGCCTTCAACGTGCAGCATCGGACCTCGGCACTATGGAGATCCGAATCTCCATCGTATGGAA
TGTCATAAACACAGGGCCTTACAGAACTTCCTCGTCCGATGTCGAGTGTCGATCCATGACATCATAGA
AGCCCTGAACAAGAACCTGCACCGACTTCAGAGCCTGCTATCAAGATCTTGATACATTTTGGATGAAAA
ATGATGATGAGTTCCTAAGAATCATGCTTTATGATGGAGCATTCATGATCGAAATAATGTTAGCGACC
TTTGAAACATATGTGTGCGCACCTTCTAGTTATCACGCAAAGGACCCAGTATTCAAAAAACCATACTT
GGTTGAAGATCTTCGTGTAGATATGCTCAGGTTGGATAATCAAATTCCAATGAAGGTCCTGGAGATAT
TGTCTGAATTCTGCAAAAACAAGATTCAAAGCATTCACCAGCTAATCAGACATTTCTTCTTCCACAAA
TATGAAGAGGGAAGATATGATATTAGCCAAACCTCTAGGATATTTCACCTAACGGAGATAACAGGGCA
TCACCTGCTGGATGTGTACAAGAAAACTCTTATACAGAATGGAGGTTATCATCACACCAACAGTCGCC
AACCACTATCGGCAGTTGAACTACAGGAGGCGGGCGTAATTTTCCAGTGCAGTGAAACGCCATCATTA
ACAGATATAAGCTTCGCCAAAGCTGTCCTTTGCCTACCTGCAGTCGACGTTGACAAAGCATTTGAAGT
TGTTATGCAGAATCTCATTGCCTATGAGCAAGCACATGGCGAAGGTCAAGAGGTAACATCCTATGTGT
TTTTTATGGATGGCATTGTAAACAATGACAAAGATATTGCCTTGCTTCGAGAGAAGGGTATTATCAGG
TCGGGAGTAAGCAGTGATAAGAGGATAGCCGATCTTTTTAATGGACTGACAAAAGGTCCAGTTGCAAA
AGTTGTCGACAATGTTGATGTTGATGTAACCCAGGACATCAATGACTATTGCAATAGAAGATGGAACA
GGTGGCAAGCCAACTTTAAGCAGAGATACTTTACGAATCCATGGGGCTAATATCAACTGAAAAAGGTT
CATAAGGCAGAAGGAAAGTTGTTACGAGAGTTGAGGGTTACATTTTTATACTCTAACATGACCCTCCA
AGTGAGCGCACACTTTCATGAGCTGAATCTGGACTTTTCTTGTAAAATCCACTTTAGAAATTCAAAGT
CAGTAAAAATTGAACCTGGCTTACTCTAG >scaffold3098 cDNA start to stop predicted by EVM1
ATGTCTGAAACCTGGGTTTCTCGATTGATATCGGATATAGAGTGGCTCAATAGCAGAAATGCCCTGAT
GGCAGACGCCTGGAGTCGTCATTCCATCTACACCGTCCCGGACACATTCAGAAGGATTAGCCCACAGA
TCCATAAGCCTTCAACGTGCAGCATCGGACCTCGGCACTATGGAGATCCGAATCTCCATCGTATGGAA
TGTCATAAACACAGGGCCTTACAGAACTTCCTCGTCCGATGTCGAGTGTCGATCCATGACATCATAGA
AGCCCTGAACAAGAACCTGCACCGACTTCAGAGCCTGCTATCAAGATCTTGATACATTTTGGATGAAAA
ATGATGATGAGTTCCTAAGAATCATGCTTTATGATGGAGCATTCATGATCGAAATAATGTTAGCGACC
TTTGAAACATATGTGTGCGCACCTTCTAGTTATCACGCAAAGGACCCAGTATTCAAAAAACCATACTT
GGTTGAAGATCTTCGTGTAGATATGCTCAGGTTGGATAATCAAATTCCAATGAAGGTCCTGGAGATAT
TGTCTGAATTCTGCAAAAACAAGATTCAAAGCATTCACCAGCTAATCAGACATTTCTTCTTCCACAAA
TATGAAGAGGGAAGATATGATATTAGCCAAACCTCTAGGATATTTCACCTAACGGAGATAACAGGGCA
TCACCTGCTGGATGTGTACAAGAAAACTCTTATACAGAATGGAGGTTATCATCACACCAACAGTCGCC
AACCACTATCGGCAGTTGAACTACAGGAGGCGGGCGTAATTTTCCAGTGCAGTGAAACGCCATCATTA
ACAGATATAAGCTTCGCCAAAGCTGTCCTTTGCCTACCTGCAGTCGACGTTGACAAAGCATTTGAAGT
TGTTATGCAGAATCTCATTGCCTATGAGCAAGCACATGGCGAAGGTCAAGAGGTAACATCCTATGTGT
TTTTTATGGATGGCATTGTAAACAATGACAAAGATATTGCCTTGCTTCGAGAGAAGGGTATTATCAGG
TCGGGAGTAAGCAGTGATAAGAGGATAGCCGATCTTTTTAATGGACTGACAAAAGGTCCAGTTGCAAA
AGTTGTCGACAATGTTGATGTTGATGTAACCCAGGACATCAATGACTATTGCAATAGAAGATGGAACA
GGTGGCAAGCCAACTTTAAGCAGAGATACTTTACGAATCCATGGGTAACTTGCTCACTCATTGTGGGA
GCTCTAGTATTAGGTCTCACCATTACTCAATACAGTATATGA

Fig. 3C

>scaffold3098 cDNA start to stop predicted by FGENESH
ATGTCTGAAACCTGGGTTTCTCGATTGATATCGGATATAGAGTGGCTCAATAGCAGAAATGCCCTGATGGCAGAC
GCCTGGAGTCGTCATTCCATCTACACCGTCCCGGACACATTCAGAAGGATTAGCCCACAGATCCATAAGCCTTCA
ACGTGCAGCATCGGACCTCGGCACTATGGAGATCCGAATCTCCATCCTATGGAATGTCATAAACACAGGGCCTTA
CAGAACTTCCTCGTCCGATGTCGAGTGTCGATCCATGACATCATAGAAGCCCTGAACAAGAACCTGCACGACTTC
AGAGCCTGCTATCAAGATCTTGATACATTTTGGATGAAAAATGATGATGAGTTCCTAAGAATCATGCTTTATGAT
GGAGCATTCATGATCGAAATAATGTTAGCGACCTTTGAAACATATGTGTGCGCACCTTCTAGTTATCACGCAAAG
GACCCAGTATTCAAAAAACCATACTTGGTTGAAGATCTTCGTGTAGATATGCTCAGGTTGGATAATCAAATTCCA
ATGAAGGTCCTGGAGATATTGTCTGAATTCTGCAAAAACAAGAAGACACTATTTGCTATTCAAAGCATTCACCAG
CTAATCAGACATTTCTTCTTCCACAAATATGAAGAGGGAAGATATGATATTAGCCAAACCTCTAGGATATTTCAC
CTAACGGAGATAACAGGGCATCACCTGCTGGATGTGTACAAGAAAACTCTTATACAGAATGGAGCTTATCATCAC
ACCAACAGTCGCCAACCACTATCGGCACTTGAACTACAGGAGGCGGGCGTAATTTTCCAGTCCACTGAAACGCCA
TCATTAACAGATATAAGCTTCGCCAAAGCTGTCCTTTGCCTACCTGCAGTCGACGTTGACAAAGCATTTGAAGTT
GTTATGCAGAATCTCATTGCCTATGAGCAAGCACATGGCGAAGGTCAAGAGGTAACATCCTATGTGTTTTTTATG
GATGGCATTGTAAACAATGACAAAGATATTGCCTTGCTTCGAGAGAAGGGTATTATCAGGTCGGGAGTAAGCAGT
GATAAGAGGATAGCCGATCTTTTTAATGGACTGACAAAAGGTCCAGTTGCAAAAGTTGTCGACAATGTTGATGTT
GATGTAACCCAGGACATCAATGACTATTGCAATAGAAGATGGAACAGGTGGCAAGCCAACTTTAAGCAGAGATAC
TTTACGAATCCATGGGTAACTTGCTCACTCATTGTGGGAGCTCTAGTATTAGGTCTCACCATTACTCAATACAGT
ATATGA

Fig. 5B

```
            570       580       590       600       610       620       630       640       650
            ..|....|....|....|....|....|....|....|....|....|....|....|....|....|....|....|....|....|..
DH00/086    GTAAGGAATGTTAATGAAATCTAAATCTTCATACCTTGAAATGTCCCAGCTGTAACTCCAGAAGAACTTGCACAAAATTTTCATACCTCG
G033        ..................................................................................CTTATTCC
9M          ..........................................................................................
88M         ..........................................................................................
12_25M      ..........................................................................................
K323        ..........................................................................................
5375        ..........................................................................................

            660       670       680       690       700       710       720       730       740
            ..|....|....|....|....|....|....|....|....|....|....|....|....|....|....|....|....|....|..
DH00/086    TAATGCAAGATTAACCTAACAGTCAACGTTGTATGAAATGATACATTATGCAAGGAGGATACTCGCACAAAATTTGCTATCCATTGAAGA
G033        TTATTCCTTATTCCTTGCAGTTATATACGTTATAGCGGATCCCATCCATCGGCTCCAAAGCTTCGGCCAGCTGTCGAGCAAGACGTTGAC
9M          ..........................................................................................
88M         ..........................................................................................
12_25M      ..........................................................................................
K323        ..........................................................................................
5375        ..........................................................................................

            750       760       770       780       790       800       810       820       830
            ..|....|....|....|....|....|....|....|....|....|....|....|....|....|....|....|....|....|..
DH00/086    TATCATTCCCATGAGATTTTTTTGCAAATAAATGAGTAATGTGCATGCTCAAGAAAGCAGTCACCATATTGAAATCATGCAGAAGACACT
G033        GCTGTCTTTGTCRTGCTCTCTTTGNNNNNNNNNNNNNNNNNNNNNNNNNNNNNNNNNNNNNNNNNNNNNNNNNNNNNNNNNNNNNNNNNN
9M          ..........................................................................................
88M         ..........................................................................................
12_25M      ..........................................................................................
K323        ..........................................................................................
5375        ..........................................................................................

            840       850       860       870       880       890       900       910       920
            ..|....|....|....|....|....|....|....|....|....|....|....|....|....|....|....|....|....|..
DH00/086    ATTTGCATATACATCATATATGCTCTATTGAACTAAGACCTGGATAAATAACTTCTGGATAGATAAACTTTATTGAAATCCTGCAGAAGA
G033        NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
9M          ..........................................A...............................................
88M         ..........................................................................................
12_25M      ..........................................................................................
K323        ..........................................................................................
5375        ..........................................................................................

            930       940       950       960       970       980       990       1000      1010
            ..|....|....|....|....|....|....|....|....|....|....|....|....|....|....|....|....|....|..
DH00/086    CACTATTTGCTGTTAAGTGTTGAACTTTGTGTATGGATCCCTTTATAAAGCTATCGTAATTTATGCTGTTGCTTAAAGCAAATAACTTTT
G033        NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
9M          ..........................................................................................
88M         ..........................................................................................
12_25M      ..........................................................................................
K323        ..........................................................................................
5375        ..........................................................................................

             1020      1030
            ...|....|....|
DH00/086    TT-CTGTCTTCCAG
G033        NNNNNNNNNNNNNN
9M          ..-...........
88M         ..-...........
12_25M      ..T...........
K323        ..T...........
5375        ..T...........
```

Dataset: 10 developmental stages (sample selection: AT_AFFY_ATH1-1)
10 genes (gene selection: AT_AFFY_ATH1-0)

Fig. 9B

Detailed view of selected categories (absolute expression levels)

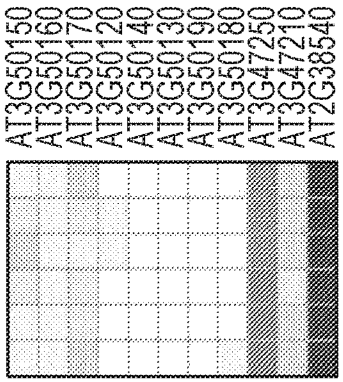

| Flower | flower bud stage | flower stage | Global sample characteristic |
|---|---|---|---|
| Flower maturation_wt_flob_stage 12_rep_1 | largest (oldest) closed bud | | wildtype |
| Flower maturation_wt_flob_stage 12_rep_2 | largest (oldest) closed bud | | wildtype |
| Flower maturation_wt_flob_stage 12_rep_3 | largest (oldest) closed bud | | wildtype |
| Flower maturation_wt_flo_stage 13_rep_1 | | youngest open flower | wildtype |
| Flower maturation_wt_flo_stage 13_rep_2 | | youngest open flower | wildtype |
| Flower maturation_wt_flo_stage 13_rep_3 | | youngest open flower | wildtype |

Percent of Expression Potential

Created with GENEVESTIGATOR

Fig. 10

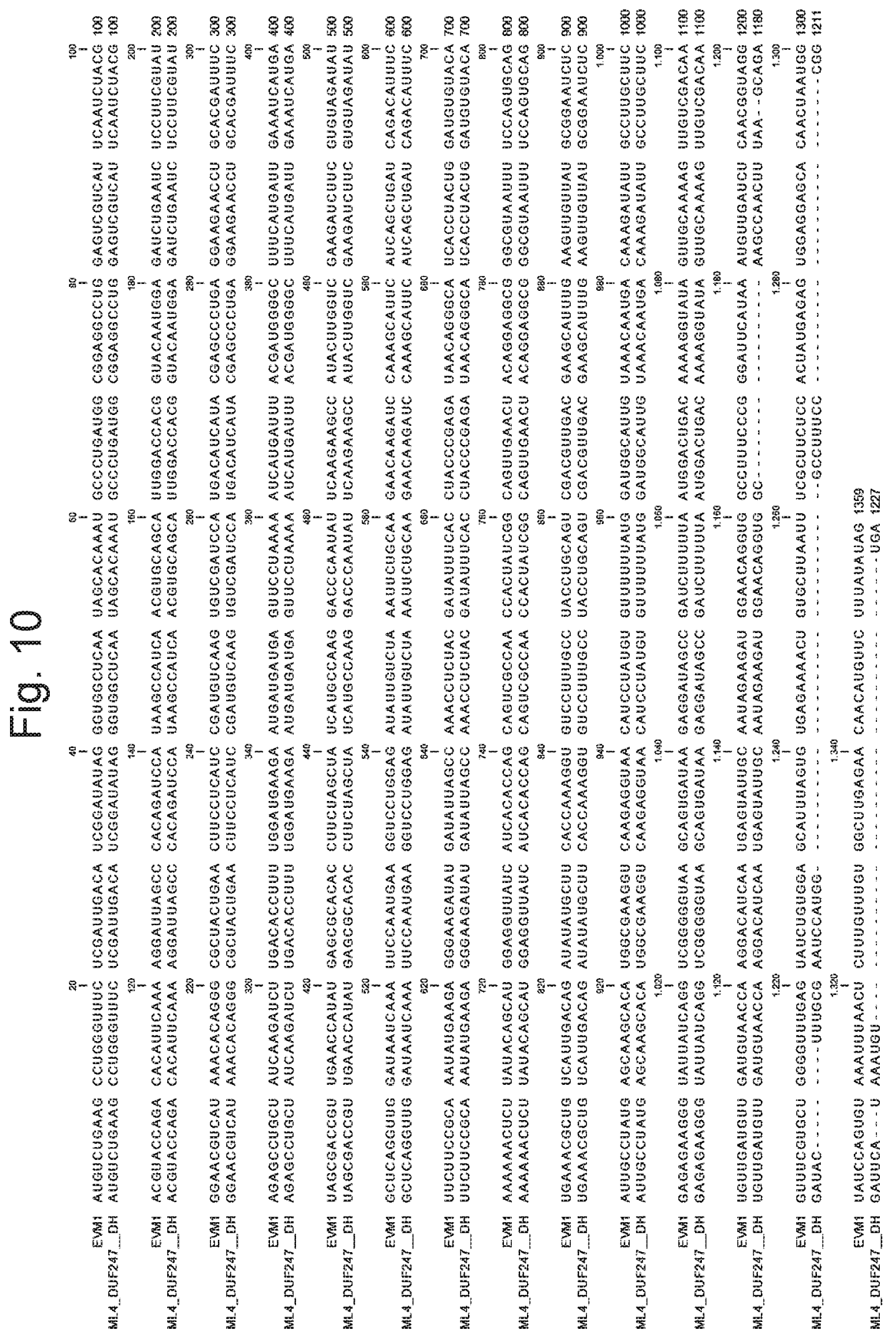

```
EVM1          AUGUCUGAAG CCUGGGUUUC UCGAUUGACA UCGGAUAUAG GGUGGCUCAA UAGCACAAAU GCCCUGAUGG CGGAGGCCUG GAGUCGUCAU UCAAUCUACG 100
ML4_DUF247__DH AUGUCUGAAG CCUGGGUUUC UCGAUUGACA UCGGAUAUAG GGUGGCUCAA UAGCACAAAU GCCCUGAUGG CGGAGGCCUG GAGUCGUCAU UCAAUCUACG 100

EVM1          ACGUACCAGA CACAUUCAAA AGGAUUAGCC CACAGAUCCA UAAGCCAUCA ACGUGCAGCA UUGGACCACG GUACAAUGGA GAUCUGAAUC UCCUUCGUAU 200
ML4_DUF247__DH ACGUACCAGA CACAUUCAAA AGGAUUAGCC CACAGAUCCA UAAGCCAUCA ACGUGCAGCA UUGGACCACG GUACAAUGGA GAUCUGAAUC UCCUUCGUAU 200

EVM1          GGAACGUCAU AAACACAGGG CGCUACUGAA CUUCCUCAUC CGAUGUCAAG UGUCGAUCCA UGACAUCAUA CGAGCCCUGA GGAAGAACCU GCACGAUUUC 300
ML4_DUF247__DH GGAACGUCAU AAACACAGGG CGCUACUGAA CUUCCUCAUC CGAUGUCAAG UGUCGAUCCA UGACAUCAUA CGAGCCCUGA GGAAGAACCU GCACGAUUUC 300

EVM1          AGAGCCUGCU AUCAAGAUCU UGACACCUUU UGGAUGAAGA AUGAUGAUGA GUUCCUAAAA AUCAUGAUUU ACGAUGGGGC UUUCAUGAUU GAAAUCAUGA 400
ML4_DUF247__DH AGAGCCUGCU AUCAAGAUCU UGACACCUUU UGGAUGAAGA AUGAUGAUGA GUUCCUAAAA AUCAUGAUUU ACGAUGGGGC UUUCAUGAUU GAAAUCAUGA 400

EVM1          UAGCGACCGU UGAACCAUAU GAGCGCACAC CUUCUAGCUA UCAUGCCAAG GACCCAAUAU UCAAGAAGCC AUACUUGGUC GAAGAUCUUC GUGUAGAUAU 500
ML4_DUF247__DH UAGCGACCGU UGAACCAUAU GAGCGCACAC CUUCUAGCUA UCAUGCCAAG GACCCAAUAU UCAAGAAGCC AUACUUGGUC GAAGAUCUUC GUGUAGAUAU 500

EVM1          GCUCAGGUUG GAUAAUCAAA UUCCAAUGAA GGUCCUGGAG AUAUUGUCUA AAUUCUGCAA GAACAAGAUC CAAAGCAUUC AUCAGCUGAU CAGACAUUUC 600
ML4_DUF247__DH GCUCAGGUUG GAUAAUCAAA UUCCAAUGAA GGUCCUGGAG AUAUUGUCUA AAUUCUGCAA GAACAAGAUC CAAAGCAUUC AUCAGCUGAU CAGACAUUUC 600

EVM1          UUCUUCCGCA AAUAUGAAGA GGGAAGAUAU GAUAUUAGCC AAACCUCUAC GAUAUUUCAC CUACCCGAGA UAACAGGGCA UCACCUACUG GAUGUGUACA 700
ML4_DUF247__DH UUCUUCCGCA AAUAUGAAGA GGGAAGAUAU GAUAUUAGCC AAACCUCUAC GAUAUUUCAC CUACCCGAGA UAACAGGGCA UCACCUACUG GAUGUGUACA 700

EVM1          AAAAAACUCU UAUACAGCAU GGAGGUUAUC AUCACACCAG CAGUCGCCAA CCACUAUCGG CAGUUGAACU ACAGGAGGCG GGCGUAAUUU UCCAGUGCAG 800
ML4_DUF247__DH AAAAAACUCU UAUACAGCAU GGAGGUUAUC AUCACACCAG CAGUCGCCAA CCACUAUCGG CAGUUGAACU ACAGGAGGCG GGCGUAAUUU UCCAGUGCAG 800

EVM1          UGAAACGCUG UCAUUGACAG AUAUAUGCUU CACCAAAGGU GUCCUUUGCC UACCUGCAGU CGACGUUGAC GAAGCAUUUG AAGUUGUUAU GCGGAAUCUC 900
ML4_DUF247__DH UGAAACGCUG UCAUUGACAG AUAUAUGCUU CACCAAAGGU GUCCUUUGCC UACCUGCAGU CGACGUUGAC GAAGCAUUUG AAGUUGUUAU GCGGAAUCUC 900

EVM1          AUUGCCUAUG AGCAAGCACA UGGCGAAGGU CAAGAGGUAA CAUCCUAUGU GUUUUUUAUG GAUGGCAUUG UAAACAAUGA CAAAGAUAUU GCCUUGCUUC 1000
ML4_DUF247__DH AUUGCCUAUG AGCAAGCACA UGGCGAAGGU CAAGAGGUAA CAUCCUAUGU GUUUUUUAUG GAUGGCAUUG UAAACAAUGA CAAAGAUAUU GCCUUGCUUC 1000

EVM1          GAGAGAAGGG UAUUAUCAGG UCGGGGGUAA GCAGUGAUAA GAGGAUAGCC GAUCUUUUUA AUGGACUGAC AAAAGGUAUA GUUGCAAAAG UUGUCGACAA 1100
ML4_DUF247__DH GAGAGAAGGG UAUUAUCAGG UCGGGGGUAA GCAGUGAUAA GAGGAUAGCC GAUCUUUUUA AUGGACUGAC AAAAGGUAUA GUUGCAAAAG UUGUCGACAA 1100

EVM1          UGUUGAUGUU GAUGUAACCA AGGACAUCAA UGAGUAUUGC AAUAGAAGAU GGAACAGGUG GCCUUUCCCG GGAUUCAUAA AUGUUGAUCU CAACGGUAGG 1200
ML4_DUF247__DH UGUUGAUGUU GAUGUAACCA AGGACAUCAA UGAGUAUUGC AAUAGAAGAU GGAACAGGUG GC-------- ---------- AAGCCAACUU UAA--GCAGA 1180

EVM1          GUUUCGUGCU GGGGUUUGAG UAUCUGUGGA GCAUUUAGUG UGAGAAAACU GUGCUUAAUU UCGCUUCUCC ACUAUGAGAG UGGAGGAGCA CAACUAAUGG 1300
ML4_DUF247__DH GAUAC----- ----UUUGCG AAUCCAUGG- ---------- ---------- ---------- --GCCUUUCC ---------- ---------- -------CGG 1211

EVM1          UAUCCAGUGU AAAUUUAACU CUUUGUUUGU GGCUUGAGAA CAACAUGUUC UUUAUAUAG 1359
ML4_DUF247__DH GAUUCA---U AAAUGU---- ---------- ---------- ---------- ------UGA 1227
```

Fig. 13A

>lcl|N-locus_scaffold4
GAGGAAACTTCGTCCTATTCCCCCAACTTAAATTATTACAAAAAATCAGGAATAAGGAAAAAAGAAAAAATTTCCTTCTCTAAAATT
TCAACTAAGACCATTATCAACTTCTTCCAAATAATTTGTACCCATCATCAGTTTCTACCGTTCTCACTCATCGAAACATAAATTTTA
CAGTTTCTACAAGAATAAAATAAACAAGACTGAGTCATAGAGAGAGGAGAAGATGGCAGCGAGATCGGAGGAGAAGATCTTGTCGAA
CTAGTAGGGATGAGCTCAAGGTTGGTGGTGTTGGCACTGGGGGATGGGGAGAGATAGACGATGGGATTCGACGGAAAGATGAAGAGG
GAGAGGAGGAGGGTTAGGAGAAAGTAGGAGAGGAGGTTGAATCGAAAGTTGAGAATGACGACGAGCTCGAGAAAGGAGTAGATGGCA
GCGAGTTTGAAGGAGAAGATCTTGTCAAACAAGTTGAGCATGAGCTCAAGGTCGGTAGTGGCGAAGGGCAAGGCGACAGAGTTAGAC
GGCAGATGCCAAGGAGAAGATGAAGAGGGAGAGGAGGAGGCTAAGGAGAGAGTAGAAAGAGATGAGGCTGAATCACAAATGGGACGA
AAGTTATGAGATCGAAGAGGGGTCTTTTCGGAATTCTCAAACGACATTTCTTGGGGTAGAGTGAAAAGAGGGCTGAATCAAAAAGAT
GCAATGTATTTGGGGCTAAAATACAAGAGGGAAATAATACGGTGGCTTGAGACACATCAAAGTTTAAATTTTAGGGCCTTCACACAA
CTTTCCCAATTTTAAATTCTTGCTCTCCTAACCAAACGCAAAACAAAAGAAAAAAAACCGAAAAAAAAAGAAGAGAAAAATTAATAA
CAGGAAGAGGCCGAAAGAGGCTTTTATTTTCCATTTCACTGGTGAGGGAGGAAGATTAACTGAACCTCCCCTTTATACCCTCTAGTT
ATTCTAGCGACACGAACTCAACTCCAGGTGACAACATTCATAGAGACGATAAACCTCATCACCTCATATGCACCTTCACAACAATTA
CCATCTCCTGACAGCAAACCCGCCGGTCCCATATCAGCCCTCTGCATTCGCCTCCCTTCGAGCTCCCTTCTCAAACCTGTCTTCTCC
AAGTTCCAAGATTCACCTTCTTGAACAAGATTCAAGAACATGTCTGAAGCCTGGGTTTCTCGATTGACATCGGATATAGGGTGGCTC
AATAGCACAAATGCCCTGATGGCGGAGGCCTGGAGTCGTCATTCAATCTACGACGTACCAGACACATTCAAAAGGATTAGCCCACAG
ATCCATAAGCCATCAACCTGCAGCATTGGACCACGGTACAATGGAGATCTGAATCTCCTTCGTATGGAACGTCATAAACACAGGGCG
CTACTGAACTTCCTCATCCGATGTCAAGTGTCGATCCATGACATCATACGAGCCCTGAGGAAGAACCTGCACGATTTCAGAGCCTGC
TATCAAGATCTTGACACCTTTTGGATGAAGAATGATGATGAGTTCCTAAAAATCATGATTTACGATGGGGCTTTCATGATTGAAATC
ATGATAGCCGACCGTTGAACCATATGAGCGCACACCTTCTAGCTATCATGCCAAGGACCCAATATTCAAGAAGCCATACTTGGTCGAA
GATCTTCGTGTAGATATGCTCAGGTTGGATAATCAAATTCCAATGAAGGTCCTGGAGATATTGTCTAAATTCTGCAAGAACAAGGTA
AGGAATGTTAATGAAATCTAAATCTTCATACCTTGAAATGTCCCAGCTGTAACTCCAGAAGAACTTGCACAAAATTTTCATACCTCG
TAATGCAAGATTAACCTAACAGTCAACGTTGTATGAAATGATACATTATGCAAGGACGATACTCCCACAAAATTTGCTATCCATTGA
AGATATCATTCCCATGAGATTTTTTTGCAAATAAATGAGTAATGTGCATGCTCAAGAAAGCAGTCACCATATTGAAATCATGCAGAA
GACACTATTTGCCATATACATCATATATGCTCTATTGAACTAAGACCTGGATAAATAACTTCTGGATAGATAAACTTTATTGAAATCC
TGCAGAAGACACTATTTGCTGTTAAGTGTTGAACTTTGTGTATGGATCCCTTTATAAAGCTATCGTAATTTATGCTGTTGCTTAAAG
CAAATAACTTTTTTCTGTCTTCCAGATCCAAAGCATTCATCAGCTGATCAGACATTTCTTCTTCCGCAAATATGAAGAGGGAAGATA
TGATATTAGCCAAACCTCTACGATATTTCACCTACCCGAGATAACAGGGCATCACCTACTGGATGTGTACAAAAAAACTCTTATACA
GCATGGAGGTTATCATCACACCAGCAGTCGCCAACCACTATCGGCAGTTGAACTACAGGAGGCGGGCGTAATTTTCCAGTGCAGTGA
AACGCTGTCATTGACAGATATATGCTTCACCAAAGGTGTCCTTTGCCTACCTGCAGTCGACGTTGACGAAGCATTTGAAGTTGTTAT
GCGGAATCTCATTGCCTATGAGCAAGCACATGGCGAAGGTCAAGAGGTAACATCCTATGTGTTTTTTATGGATGCCATTGTAAACAA
TGACAAAGATATTGCCTTGCTTCGAGAGAAGGGTATTATCAGGTCGGGGGTAAGCAGTGATAAGAGGATAGCCGATCTTTTTAATGG
ACTGACAAAAGGTATAGTTGCAAAAGTTGTCGACAATGTTGATGTTGATGTAACCAAGGACATCAATGAGTATTGCAATAGAAGATG
GAACAGGTGGCAAGCCAACTTTAAGCAGAGATACTTTGCGAATCCATGGGTAACTTGCTCACTCATTGTAGGAGCTCTAGTATTAGG
TCTCACCATCACTCAAACAATCTATGCATCCTTTCTTATAATAACTGTAGTTAATGTAACTCTCATACTCGAAAATGTATGGATGA
TTCCAGTCTTGATCCCAGTCTTTTGTCATGGCTGTGTGGCTGTAAGCATTGTAATTTGAGACAATGACAAGGATGAATAGGCTAATA
TCAACTGAAAAAGCTTCATATTTTTTTTGGTTTTTGCTCAAGATTGAATAAAAATGGCTTTAAAAAGGTAATGTGTAACAATGTCTC
AGATTTTATTCTTTCCACACCCTGAACTCAACTTGGTTGCTTCTGTGCCCAAGTCAAATATTAATAAAACCATGTGCCTTTCTTGCA
AGATCTTGGATTTTGTTCGGGTGCCATTTAATAAGAGAAGCTTGAAGGCATCCCTTTGCATTACCCAAATGGAATCTGGGAGCTATG
TTTTAATTACATTTAAATAGTGGCTCTTTGAGGGTGTTTGTCTTTCAAATGTTCAGTTCCATGTCTTACTTCCAGTTATAATTTTTT
CTAGTGTAGTGATACTCTTAGTTTCTGCTCATGATTTAATGCATAGTATCTGGCAACCAATAAATGCAAATGCATTAGTGTCGATCA
CATAACAAGAAATGATTAGTTCTTCGAGCCAATTTAATTTTCTCTGTTATTCCTTGATTTCCAAAACTTTGTTATTGTTTTGTCTTA
TCTGATCTCAGTCTTTCTTTGCAGGCCTTTCCCGGGATTCATAAATGTTGATCTCAACGGTAGGGTTTCGTGCTGGGTTTGAGTAT
CTGTGGAGCATTTAGTGTGAGAAAACTGTGCTTAATTTCGCTTCTCCACTATGAGAGTGGAGGAGCACAACTAATGGTATCCAGTGT
AAATTTAACTCTTTGTTTGTGGCTTGAGAACAACATGTTCTTTATATAGCCTTTGACAATGTAATAGATAACATCAACTTCTTTGAT
ACATACTAGCGATATTAGCATCCTATCTTTTTCTTCTTCATGTTAACAATCCTATAGCCTTTACACGGGTAATATATCCTTGTGATG
TTTAATCCTAAGTTTTTCTCTGGTCAGTGAATATGAACAGCAGCTATTATTTTATTGCTTGTTCTTTGTAGCCCAAATACTTTTATG
GTAAAATGCTCACCATAATTTTGCAGTAAATATCCGATTACCTCATTGTTTCTCTATTCCACTTAGCTACAATATAGCTTCATTGTC
TGGTGTACATTCAAACAAATTAAAACCTGTTTTTTCACTCCTAATTGAGGAGTGAAAAAGACAAGGAAGCCCATATAGTTAATTTTC
TTTAATGTTGACAGCAACCTCAACCACCCTCATAATAGATTTCATGTTTATTCCTCAAACTTATACTTCTTGCATAGTTCTATTAAT
GTGTATGATTACAATGAAATGTTTTGAAACCATCTTTTTAGTGTGAGATTTATGATGCATCATTTGAGATTTAATTATATTTGCGAT
CGAGAATTATATTAGTCTACTTCTCATAATACATTTACTAAATCCCTTTTGTTACTTGGTGTGAATGGAGCCATTGAACCATGTGAA
TTTATGCAGCTCCTTATTGTCTTTCTTTTTAATATTTCTGTAATGTACTTGTGTATTTACAACCTTTAAGTATATTTCAGCATTAGC
TAATTTTTTAAGTAGCATTTTCGCTTTTGTATCAATTTTCTTTTTAACAGAGTCATAATTGTTGTGCTTCATTCAAGTTGATCACC

Fig. 13B

AATATCACTGTAGGGTATCAATTCTATTGTTGGTCCTAAAACTGCTAGGAATATCGTTGTCTGACCTGAGCTTGATTTTTGTTTCTT
TTACTAATTATTTGTGTCTTTTTAGTAAACATGACACATGTTTATTATGTTTTTGTTCATATGTCACCAATACAGCTGTAGTGCATC
AAATCAGTTTACACTTACAGTAGTTCTCTTCATTTTTGTTCTGATACTGCAGTTTCCGTTGTTGAAGCAAAGAAATAACTAATAAGA
CAAAGCAAGACAGATGAGTGCAATAGTTCTAAAAATTACTGCACATGATTTTCTAAAAAATGAAGCATTCACATTACAACATTTATT
TCCTACTGTAAGTTAACTCCATAAATAGAAAGCTGCAAGTTTCAGGCATAAATTGTGAAGGGAAAATAGCTTGCTTTTCCATGGAAA
CAAGGTTCATATCTTCTTCCATTTCACATGGTTATGATTCAAATTGTTTCCTTTAGTAGTTTTGCATGTGCAAGTCTGTGCTTGGTG
GTTGTGTTTCTCCAATTCCTGCTCAAAGTAATTGTTTGTTATAAATTTATTATAAAATTAATGTGGAAATTCATGAGGTTTATATGT
TGATAGCTTCATGAGAAAGACTACGGATGAGTGAGAGACTTGTACACTTGTGCAAATTTGTTCATTTATGCAAACTTCATGTCATTA
ATTGTCAAAGCGTTTTCCATTCTGGTATGTGTAAAACATGATATAATTGAAATAAAAATCTACATTACCATCAAAGCAAAATTCTTT
AAACAAGCATTCCAAACGAGAATTAAAAAAAAAATACTGAAATATGACCAGTCAATGAGGTCACAAGACTAACATAAGCTTGGCGTG
AATAGTTGCTGAGGATTCTCAATATGCGAGGCATTTGGAAGCACCAAAATCCGCACCCTACCGAGTACCCAAATCAAACACTTTCCA
TGGTGCCTTTCCACTATCTTCCTCACAATGTAATCTTCTAGTGAAATAAATGCAGTTACCTCTGTTGAGAGAGTGGATAGCCTTCTC
ATCAAAGAGCTAGCAGTGTTCACCTACCCCCGTGCTACAATGTTCACCTACCCCCTGCTACAGTGTTCACCTGTCCCAAATAGTGTT
CACCTGCCCCCATGAGAAAATTTATAAATATCCCCCTAAGTTTGATTTGTAAGGTATCTCAGTAGCAGAGAGAGAAAGAGAAAGATA
CAGATATAAGTGATATCATTGAGAGCTCTTGAGAGAGACTTTGTAAGAATTCTTGGAGAGTGTATTGAACAAGAGAGGGTGTTCTCT
TTTATCTTTATTTTTGTAACCTCGAAAGGAATATAAAGGAATTGGGCGTCGTCGTTGCACCGTGGAGTAGCTCCGTAAGAGTGAACC
ACGTTATATCTGTGAGTACTGTGATTGAATTCGTGTTTATTGGTTCTATTATGTCATTCTAAGATCGTTTGCGTGTGTTTTGCGTCT
CCATTTGAGGCTTTCTTGTTAGCGTGTACCCTAACAAGTGGTATCAGAGCATACGGTTTGGGAAAGACGGAATCTTTTGCTATGGGA
TCTACAGTTGAAGATAACATACTTCGGATTGAAAAGTTCGGCGGCCAAAATTTTAGGTATTAGAGGATGCAGATGAAAGACTATTTG
TACCAAAAGGATCTCTTCATACCCCTCCAAGTAGAGGCGGGGAAACCTGAGAAGATGGACGATGATAAGTGGAAGGTGCTCGATCGT
AAAGCACTTGCTGTTAGTTCTCTTGTTTTGATGATGATTTACAAACATCATTATTGGTGCTAATTGCTTGTTGAGTTATATTGTGTA
GATTATAATTTATCAAGCAAGTTAGTGTTAATGTTGGAGGATTGGATGGAATCAAGCTCAACGATGATATCCATGGAGGTGGAGGAA
ATGTGTTGAAGCAAAGCTTTCAAGAGCACAATACATAAGAGAAGCTTCATCAAAATATGAGCAAATATCAAGACCAAAGAATTGTAT
TCATATAGATATTTGCATCTTTCTCTTTCTCTCAAGTGCTTGATGTAGACAAGTTATTGAGTTGATAACATTTGAAGCTCATTGGGT
TCAACATACATTTTCACAAAAACATTGTTTTTGAACTATTTGAAAAATGAGCAGTTTTACTATTGGAAAATGATCTTTCAGAAATT
CTTGTTCTAACATGTTCAAAATCATGTTTATAAGCATTTTCTAAAGTTTTATAATTTTTGGAATTTATTTGATATTTTATTTTGATT
TTACAAAGTCAGATTTTCAACTAACATTAAATTCCTGTATGTACATGTTTTCGGTCGACCGGGCTTTGCCCGTCGGTCGACCAACTA
GAGAAGCTGTTTTCATGACCCTGCAAATAGTCACTTGCGGTCAACCGATTTACATTGCGCGGTCGATCGATGACTAAGGGTCAGTCA
ACCGGAACATCATTGTCGGTCGACCGAACCAGTTCCAGATTGCTGAGTCTGCAACGGTCAAATATTCAGTCGACCGGACATTATCCA
TCGATCGACCGGATCTTCTATAATGGCTAGTTTTTGTACCAGTTGATTTTCAGGATTTTGGTACTTGTTTGGAATTTGGGCTATTGT
TTGGGGTTCCTATATATACCCCATTGCTCTCTTCACTTCAGTAATGATTTTAGCAAGAGAAAAATCTTAAGTTTAGTTTTCTAAGTG
TTCTTAAGCTCAAACTTTCAATTCTTAATCCTCAATTGTGTTTAATCCTTTGTTTTTCTCACATCCACACTCCACAACCCTTGAGCT
TTACTTGTTCTTCACTTGATCCTTGTCATAGGATTGTTGTGAGAGTTTTTCATTCTTTCATTGTGATTGTGTGGTGAGATTGATCTC
GAGGAGATCACTCGTGTGGATTGTAAAATCTTAAAAGGAGATCATTGTGAAGAAGTTCCGGCTTTCAAACCGGGTGTGATAGTAAAG
TTACCATCGGGAGAGGTGGTCGGGACGTAGGTCGGAGGATCGAACCTCGTGAACTTATCGTGTGTCACTATTGGATAACTATTCTCT
AAACTCTTTCTTTATTTATTGCCTTTGCATTTAATTTGGTTGGTGTGTTACATTGACAAATTTTAATTGCACATTTATTGTCACATT
ACCCTATTCACCCCCTTAAGGTAATTTCAATTGGTATCAGAGCAAGGTCTCTACATATTTATTAGGTCTAACACCTTAGAGAAAAGA
TCCAAATGGATTCTACAATGAATGTGCATATGCTTGAAGGTCAATCCACCACTATACCCTCTTTGTTCACCGACAATAATTTTGCAT
ATTGGAAAGCTAGGATGAGAATTTACTTACGATGCATTGAACTTGACATCCTAGAAATAATAGAGAAGAAATATGTTGAGAAGTCTA
GTAAAGATATGACCAAGCATGAAAGCCATTTGGCTAACCTAAATGTTAAAACCATGAACGCTTTGATTTGTGGTCTCACCCCAAATG
AGTACAATAGGGTCTCCATATGTGCAATCGCACATAAGATTTGGGAGAAACTATGTGTTACTCATGAAGGAACCCCCAAGTCAAAGA
GTTCAAAATTAGTAGCCTCATGCATGATTATGAGTTATTTAAGATGCTTCCTAATGAGTCAATTGATGCCATGTTTTCTCGATTTAC
TAACATTGTTAATGAATTGCATGGCCTTGACAAGGTGTTGGAGAACCAAGAGAAGAATTATAAAATTCTTTACTCTTTAACGCCGGC
ATGGGAGCCTAAAACTACGGCTATCGAGGAAGTCAATGATCTCAGAACATTTACACTTGATGGTCTCATTGGCAAGCTCAAGGTCTA
TGAGAAGAAGATCAAGGAGAAGGAGGAAGTGCCCTCTCGAGCAAATGAAGAGCCTTCCCAAAAGATGAAAACAATTACGCTCAAAGG
AGCAATTGATGATTCCTCCTCCTCGGATAGTGAAGTAGATGTCTCTAAAGAAGTGGCACACCTCTCTAGAAGGATATCAAGATTAAT
AAAGATGAATAAAATTTTTAAAAATCATTCTAACAAGTTCCCCTCTCGTGTAGGTAAATGTTTTGAGTGCAATAAACCGGGACACAT
AGCAAAGGATTGTCCCAAGATAAAAGAGAAGTACATGAACTACAAAAAGAAGAAGGCAATGTATGCGGGATGGGAGAAATCCGAACC
AAGCGACTCGGATAGTGACGAAGAAGCCTGATAATCACATTTTATTACAATTTTATACCCTTATTATCTATTTTATATGAATAAATA
TGCCATTAATAATTGTTTTTATCTTTAATTGCAGGTTAGTAAAGAATAAAACCCAAGATCTCTTATCTTAACAAAAACCCATAAATT
AAATGAAGAACACAAGCAAGAGTCAAAAAGCCCAAGCCCAGAATCAAGCCGAGTAGCCTGTAGAAGCCGGAGAAAATAAAAAAATTA
AATATCAAAAAAATATATTCAAGATACTTGGCCGTAAAGAAACGACGATATCTTCCAATCCGAAAGGCAAAATTTAACATATAATAT
ATGAAAATCGCCTATCTCGACGAGACCAAGCTAACCGTAAAGTCAAAATTTTTATTGGAGCATCGATGCCAGTATCGATGCGGCCAT
CGATGCCTGTATCGATGCGAAGTCATCCAGATTTCATCAACGGCCGAAATTGCATTCTTGGGGCTCAAGTTTGATCCAAGGGCTCTC
ATTCACTGATGTTTACTATAAATAGGGGTTGAGAGTGAGGGTTAGAGGTGTGAAAATTTTTGTAACTCTTTTTGGAGAGGAGGGCT
ACTTTAATTGAGAAGGCCTTCCAAATTTATAACTTTTTATTACAATTAATAAAATAATTTTTTTTACCACTGTAAATTTTTCTCTT
CTTCTCTTTGTTGGATGATGAAGATGAAGATGAAGATGGAGATTAATTTGAAGGTATGTTTTTCTTATTTCTCTTTAATTGCTTATT
AGTTTAGATTTATTTTCATGCTTGCAAATAGATTTTATTTTCTTGTTTAAATAGCCAAGAGGCTAGAACCCTCTTGCCTTAGATTTA
TTTCATGCTTATAGATTAGATTTATTTCATGCTTATAGAGTAGATTTATTTTTTTTGCATTTAATTCTTGTAATTTATTTTGTAGTT
TAGATTTTGTAATTTATTTTGTAGTTAGATTTTAATTTTTTATACTATTCACCTTGAGGCTAGAACCCTCTTGGATTTAGTTTTTCT

Fig. 13C

TTTTATTCATTTTTATTTTTTTTATTTGCCTTTAGGCTAGAACCCTCTAGGGAATCATATTTTTCTAAGAAGTGGATTCAATTCTAG
GTTACCCATATCTTTAATTGAATCCGCTATCTTTACATTCTTGATTTTTATTTGTTCTTGATTTTTCCTTCTTGCCTTGTTGATCAC
ATTTACATTATCACTTCCACTCTCAAATATATTCATTTACATAATCATTTTCATCTTTCCACAATCACATTCACTTATCACTCCTAT
TTGTCACGCACACAACATAAGAACCGATTTTATATTTTCTCCTACAAAACACCTTCCTCGTGGATCGATATCTTTATACTATAACTT
GACACGGTTGTGCACTTGCAACATTTTTGGTACATATTTATGCCGCATCAAGTTTTTGACGTCATTGCCGGGGAAGGTGCTTAAGTA
TGTTTTAATTATTTTGGTTCTTTAACTTGTGTGTTTATTGTGAAGGAAACGCTTGAAGCTTGAAGATCCCGGATTGGAGAACTAGGA
TTTGAAGATTTGCTTGTAGGTAATTCTTCTTTTTAGAATTTTTAATTCCACCCTTTAGCTACTTCTTCACAATTAGAGACAATTAGG
ACTTAAAAAAAGAGATTTTATTTTTGTTGACCATAATAAAATTCACCCTCCACTTTGACATTTACTAACAAGATAATAAATTCAAAT
AATATCCCCCTTCTCATTTGTTTAATTGTTAACCCTAATTAAAAAAAAAGGTTTTTTCTTTTCCATCCTTTTTAGTTGCTTTTAATT
CATTGGGTTTCATTTCATATTGTTAGTAGGAATTCACCAAGTGATTTGAGCATCTTGATTTGGCACACACTTAAAAAATATTTTTAAG
GGTAAAACCCCATATTCAAGATAAGGTGAGGGATTTCATCACCCTTCCCTTAGCCCAAAAATCACTAATTCCTCACTAGACCACCCA
AGCCTAATAAAACTCATTAGACGTTGGCCCTAAGGATTCGAGCTCAATAAGGAACAAAGAATCCTTAAGTGAACCGGTTTAAGTTTT
CTTGGATTAGTTGGTGTCTAAGGCAAGGTTTAGGGGTTATGTAAAACGCTCCGCAAGGAACGAGGTACTTAATTGATCTCTGATCAC
CCTCTAGTACTATCCTTACCTGGCTAACTACCCGGGTAAAACTTTAATCTTTTCACTTTAGGAGTTTTTGGTTAGGAGGTAGTCTAG
TTGAGTTAAGCTTAACCCTAGAGTTAGAGTGATTGGAAAGTGATTGATTTTGATTTGTTTAGTTAGGATTTTTTTCTCTTTTTCCAT
TCTCTCCTCATTAAAAAAAACTAACCTTTATAATAATAAAAAAAGTATAAAAAGAAATAGTTTTGGTGTATGCAACCGTGGATTAGG
GATAATACACATCGATTAATTCGCTTTGAACCAATCATAGAAATAGCGTATCCTAATCCACCCGTTCTTCAAGATATGTGCTATCCC
ATTAGGAATGCAATCCCCTCTTGTATTAGGCTCCCCGAAACAAATGGAATAAATTTTGAGCTTAGAGCGTATTACATAAATATGCTT
CCCAAATTCCTTGGAAATGAAACAGAAGATGCATATATTTTTATCTTGGAATTTGAGGAAGTGTGTATTATGATTAAAATGAGAGAA
TTAACAGAAGATGCGATCAAACTCAGATTTATTCCATTTGCTCTTAAAGACAAAGTAAAAAAATGGTTGTATAGCTTACCCGTAAAT
TCCATCACTACTTGGGAGGAATTTATCACCGTTTTTCTTAAAAAAAAAAATTCCTATCCATAAAACGATAAAGCTAAGAAACAGCAT
CATGAATTTTAAAATTATCCTAGGAGAACCTTTTTGGAAGTATTTTGACCGATTTAAAGATCTTCTCATCTAATGTCCTCATCACGG
TTTAGAAAAATGGTGATTGTGCCAAATAATTTATGAGGATTAGATTATTCTACAAAAACTTCCTTAGAATCAATGTGCCATGGGGA
TTTTATGAGGAAAAATACCGATGAAGCTTGGGAATTTCTAGAGAGTCTATCCGAGAAAACAATGCAATGGGAACACTGTGATAACAT
GGTTTTATCAGTTCCCCATTCTAAGTCTAATGGTCTTTCCTTGGAGTCAAACATTACTTCTGAAGCGAAGATGACGATAATTCTGCG
GAGGTTAGAAGCCTTAGAAATTAAGGAACAAGCTCTAGCTCAAATCAATCATGTTTCTACCCCAGGATATCATAATTGTCAGTCTCC
TACCCACGTTTCAGAGGAATGTCCTCTCCTAGGAAATAACTATGCATGAGAACAGATGAACGTTGTATTCCAACGCCCTAGAAATAA
TCCATTTTCTCCAACCTACAATCCAGGTTGAAGAAATCATCCCAACTTTGCATAGAATCAAGGAAATTCTCTCGGAACTCAAAACTT
CACTCCCGCTTCCACCCAACATTTTCCTAGGGAAAACACAAATCCTTTTAATTCTCATCCACAATTTTAACAACCCAATCTGTCCGTA
TCAAAATCAGTCTCCTCTTCATCAAGCTGTAATTCAGGCTCATCACAATTCAGATCAGGATAACCATCTCAATGTCTTGGAAAGAGG
TTTGGAAACCATAATTAAGGCATCCACTCAAACCACGAATATGTTGACTCAAACGTCTAGCACTCTGAATTCCTTCATGCAATCAAC
TGGACAAATGCTCAACTCCAACACTCAAGCTATAGCTAAATTAGAATCCCAACTTGGTCAACTAACTAGTGCCGTGAGTGAAAGAGA
GAAAGGAAAATTTTCGAGTCAACCCGTGGTAAACCCTAAAGACACAGGATGCAGTTCATCCTATGAAGCTCAAGTGAATGCAATCCA
TTCACTTCAGTCAGGTAGACAGGTAGATAATCAAGTGAGAACTCCTCCAAGTCAAACTTTTGATCTAATATAAATTCCTTCTCCTTC
TCCTTTTGATGAATCTATTCAACAATCACCCCCCTTAGATGACCAAGAACTTGAACCCGAACCTGAGCCTATTTTTGATAGATTTAG
ACCAGTTGCTCCCTTTCTAGATAGACTCAGGCCTAGGAAATACTCTCCTCAGGAGGAGAAGGTCCTAGAAACATTCAAGCAGGTTAA
GGTCAACATCTTCTCTTAGATGTAATTGAACAAATTCCATCTTATGCTAAATTTTTAAAAAAAATTATGCACTAAGAAGAGGAGAAT
AAATGTTCCAAAGAAAGTCTTTTTAGCCGCCAATATCAGTGAAATACTATCAAATCCCATACCTTTGAAACGTAAAGATCCAGGTTC
CCCCATCATTTCATGTATCATTGATAATACTCACATTGATAAGGCGCTGTTAGACTTAAGGGCCAGTGTTAATTTGCTTCCATATTC
AGTCTACCAGCAATTGGGTCTATGTGTACTGAACCCAACCAGATACACCTTACAGTTGGCTGATAGATCTGTTAAGGTACCCATGGG
TGAGTTAGAGGATGTTCTGATTAAGGTTGGAGATTTTATTTTTCCAGTAGATTTTGTAGTCTTGGAAACACAGCCTGTTTCTAATCC
CAAAGGACAGACACCTGTCATCTTAGGATGACTTTTCTTAGCCACTTCTAATGCTCTCATCAACTGTAGAACTGGTCAAATAAAGCT
GTCCTTTGGGAATTTGACTGCTGATCTTAACATTTTTAATCCAGGGGACCAGCCAAATAATCAGCCTCTAGAAATAAATTATATTCA
GGAAAGATCAAAAGAAGAAGAAGAAGAGTCTGATTTAAGTTTTGAGGAAATTTTTGATGAAGAGTTTGAGTTTTTAGAAGAAGCAGA
TCAGGTCCTTGAGAATAATGAAACTGTGTTAAACATTTGCTGCTTGGAATTAAATTTTGAAGAACTCTTTCTTGATGAACTTAGATT
CTTGGAGAAAAATCAACAACTAAATTTTCAGAACTCTACAGAAGAATTGGTTGTTAGAAAATAAAACTTCACAGTACAAGAGTCTAA
GTTCATTAAAAAATACAAAATGCATGACACCAATAATACCTACCTTACTTTGTTGCAAGAATTATTGAACACCCCGAAATGTTTGGA
ATTTCACATTATTGATTATATCATTCTGAATTTATTTAAAATTCGGGAAAGAATTTTCAACAATAAGGTAGGATTCAAGGTAGAATA
CGAGCTCTTCGTGTTGAACACTTCATTCTACATTATTTTTTTTGTTTATTTCAGAATAATAAAAAGAATTTATTCTTCTCTCATTTG
AGAGTTTCTTCTTCAGTTGTAAAAAAAACAGAAAAAAGAAAAAAAGAAGAGAATAATAATTTTTTGTTTCTATCCTCCTCAGATCAA
AGATAATTGTAGATTTTTATCAGCTAATCAAATGTAAGTACTTCACTTCTTATCTGCTTTACTTTGTGCATCATGGAGTTTGCATTG
AGGATAATGTAAAATTTAGATGTGGGGTGAGAATTAGTTATTTTTTTCTCTTTTATTTTACATTTTTAGTTGCATTTTTGTCATTTT
TTCCTTTTCCTTAAAAAAATTTATAAAAAATATCGTCACTTGCCAAATTGATAGAGTTATGTAATAATTGATTTATTTGATAAATTTT
AAATTTTCTAATCTCTAGTTTGTTATTTACTCAAGTTTACCTTTTATGATAACTCTAAATAAATTTCTTAAGAAATAATTTTCAAAG
TAGAATACTTCACTTAAGTCTTAACTTAGATTTTTATTTAAAATAATGGAATTTATGCATGCTTACCTTAGAGTCAAAAATAAATTT
TCAAAGTGTCTTGACTTACATATTTTTCAGAATATATATACATATACATAAAAATATAACAAAAGAAGAGTGCGAAAAATAGACACC
AAAAGAAAAAAACTCTTAAATTCAAGGTGATTCTATCTTATAAAGCCTAAGTTGACCGAGTAATTAATCCCAAGGAGTATTTCCATA
CGTAATGATCTAAGCCTAAATGGGTTGGGATCCATTGGCCTAAAACTCGTTAAATGGTCGCTTAGAAAACCCGTTAAAGTAGAAAAA
ATCACCAAGGAAGAAAGAGTTAAAAAATAATAATAATATAAAAATATATATAAAAAAAATAAAAATACTAATAAATATTTTAGTTAT
ATTTGTATATATGATCTTGGAAAATATTTTAGATCAAGCAAATTGAATATTATTTTAAACAAAGAGTTAGCATGTTCTTTTCAAAAC

Fig. 13D

TTTTAAGTTAAATTTCTAAGTTTGGCTTGGTTTTGTATTGCTATAATGAGAAGATTTTCTAGGAAATTTACCTTTAAGTTATTTATA
AAAACTTTTTCTTGAGTGATAACTAGCTTCAATTAGATTGTCTAAAGTTATCAAGTGAATTTAGTTATTTACTGACTTCTTTAATTT
GGCAAGTAGACCGAATTTTGTGGGTATATTCACTGCAAACCCTCATGAGACTATAACTCGTCTACTAGGGTAACCTAGGGGTTTAAA
GGCTTGTTGTATGCGCTGAATACAACCGCGATTCCTGCAAAAAGTGAGTTAGGTCTTCTTTCATTTTTCTTTCTTTGCTAGAGGACT
AGCAAAAGTTTAGGTGTGGGGTATTTAATAATCATATTTTATTACATATTTATACCCTCATTATCTATTTTATATGAATAAATATGC
CATTAATAATTGTTTTTATCTTTAATTGCAGGTTAGTGAAGAATAAAGCCCAAGATCTCTTATCTCAATAAAAACCCATGAATTAAA
TGAAGAACACAAGCAAGAGTCAAAAAGCCCAAGCCCAGAATCAAGCCGAGTAGCTTGTAGAATCCGGAGAAAATAAAAAAATTAAAT
ATGAAAAAAATGTATTCAAGATAGTTGGCCGCAAAGAAATGACTATATCTCCTAATCCGGAAGGCGGAATTTAACATATAATATATG
AAAATCACCTATCTCGACGAGACGAAGCCAACCGTGAAGTTAAAATTTTTATTGGAGCATCGATGCCAGCATTAATGCGGGCATCGA
TGCCAGCATCGATGCGGGCATCGATGCCTGTATCGATGCGAAGTCATCCAGATTTCATCAACGGCCGAAATTGCATTCTTGGGGATC
AAGTTTGATCCAATGGCTCTCATTCACTGATGTTTACTATAAATAGGGGTTGAGAGTGAGGGGTTAGAGGTGTGAAAATTTTTGTAA
CTCCTTTTGGAGAGGAGGGCTACTCTTAATTGAGAAGACCTTCCAAATTTATAACTTTTTATTACAATTAATAAAATAAATTTTTTA
CCACTTTAAATTTTTCTCTTCTTCTCTTTGTTGGATGATGAAGTTAAAGATTGATACGGGTGTATCTTCTCTTCGGAACTTAGCGAT
CCTCATGAGAGCTTGAGGATAGATGATTCTCATGATAACATGAGAATAGAGGTGTCAAACAGTACAAGGGAACGCAGGAGGAAGCGT
GAAACGAGACGATGAGCAGAAGAATCGAAGTATCTAGTTTTCAGCCTGTGAGTCGACTCATAACAGTCATGAGTCAACTCACCAGGT
TGAGTCGACTCATGACTGTCATGAGTCGACTCATCGCTGGTTTTTGAGTTTTGTCCAGTTTCGGACGAGTCGACTCATCTCAGTCAT
GGGTCGACACATCGATGGTTTCCTGGTTCGTTTGGGTTTCTGTTCACACAAATTCCTGTTGGTTTTGTGTCTGGTTATTTACCAAAT
TGCCATCCACGTTTGTACACCTATATAAATGATTGTTTTAGGGTTTCTAAACAATAAGAGAGGTAATTAAGAGAGATTCTAATCATT
GTATTAGGGTTTAGTGAGAATTGAGAGTTTGTTCTCGATTCTAGTGAGATTGTGAGAGAGGGATTGTAATCTTTTCATACTCATAAT
CTAGAGAAGGTAATTTTCTTCGCCATATACTGAATTGTGCTTGTGTTTCTGTCATCCTCTTCTCAACCCGCCTTTAATAATTCCACA
ATCAAAGGTGCTCACACGGCAACTCGTATCAAGGTGGTATCAGAGCATCAGATCCGGTGAAGGGGCATCCTATGTATGGTCCTTACT
CGATCCCAATACAAGAAGCTTGGCGAGATCCTTATTTCATTGGAAGGAGTCCATGTTTTAAGGAAGAAGAAGATGGTCGAAGGAGAC
AATTCAACGAGGATTGATGCATTGGAGAAGCAGATCGAGACGATAGGTTCGACTCTCACACAACTCGTCAGTCTTATCCATGGAGGT
GGAAAACAAGGTGAATCTTCTTCGAAGAAAATTGTTGAGTCCGATGTGGAGAGAGTAGATTCAGATTCCGATGAGGAGGAGGAGACC
GTTAAGACTGCATTGCATCAAGGGGGTAAGATCTTATCAGAACCTGAAGATTGACTTCAAGGTGGAGATTCCTGTTTATGATGGGAG
TGTTAACGTCGAGAGGCTTGATGACTGGATCGAGCGGATGGAGACGTATTTACTCTTTATGGCTATTCGTCAAAAGAGAAGATTGT
GTTCGCGACTTTGAAGCTTTCCGGGCACACGTTTACGTGGTGAAAATCCTACTGCAAGCAGGAGAAGAAGGCGGTGTTGTGGAACAA
GTTCAATGAGTTACTGAGAAAGCAGTTCTACCCAGTGGGATTCCTTAAAGAATGTTGGTACAAGTGGTACGGCTTACGCCAAAGGGT
CAATCAAACCGTTTAAGAATACACCACGGAGTTCCAGCAGCAGGCGATGGTCCTCAACATTGCGACAGAGGAATATTTCGTGTTTAT
GAAGTAAATGGCAGGATTGAGCGATTACATCCGAAAGGAGATGAAGTTATTCACAGTCGAGACTATTACAGAGGCGAGCGTGAAGGC
TATTGCCATCGAGGGCAAGCAAAAGAAGGGCAACGAGGCTAAGGGAGACTCCAAACAGACGGGAGGCGAGTCTAGTGGTTCTCAATC
TAAGGAGGAGAAGAAGAAGGGTGATCTAGGGAAGACAGGGCTGATTTGTAGTCACTGCGAGAAGACAGGGCACACAGCTGATCGGTG
CTGGGAGAAGTATCCCCATCTCAAGCCAAGAGGGTTGAAGAAGAAGGAGGAGAAAAAAGCATACATGATAGCTCAAGGTCCGAAAAA
AGTCCCAGGGATGACAGAGCCCAACAACAGTCTCAACCTTATGATGGAGAAGTAGACCACGAAAGAGGACGACGACCTGAGAGACCA
ACTCTTTGTTCTTAAGTTGCAAGTGAAGACCAGTTTGGTTGATGCCATTGTTGATTCAGGCAGCGAGAAGAATTTGATATCCGAGGC
ATTGGTGCAGAAGCTGGGTCTGAAGACAGTCAAGCATCTGAAGCCCTATCTATTGGGGTGGATTCAGAAGGAGGAGAAACTGAGTGT
AGTTGATCAATGCACTGTCAGATTTGCACTCCACGGGTCGTATATTGACGAGGTCACGTATGACGTCGTTCCATTGGATGTTTGTCA
GATTATACTAGGTAATCCGTACTTATGGGATAGATATGCGATCTACAAGAGGCCGGCTCAGAAGTACACCTTCACTAAGGATGGTGT
AAAGTTCATATTTCGTTCGGCATCTCTTCTGAAGGAGACAAGTTTGGGGACGGTAGCGCGAGCGAAGAGACTAATGAATGCAAGCAA
GAAGTTTGTCTCGCTGTGCATTAGACTTCTAGAAAAGCCATCGACAAAGGATTGCAACTTAGAGCGAACGGTGACTATGACGAGACG
CGGGACGAATGAGTTGTTTCTGATCGAATGTTGAGACCGGATTCCTAGCAAGGCCAGGTGGTACAGAAAAGATGGAGGAGCTCGAGA
GTTTCCTCAGCAAAGGTTCTAACTTGAATGGGACTTCAAGTTCTTAAAGAGGGGACCCATGATACGGGTGTATCTTCTCTTCGGAAC
TTAGCGATCCTCATGGGAGCTTGAGGATAGATGATTCTCATGATAACATAAGAATAGAGGTGTCAAACAGTATAAGGAAACGCAGGA
GGAAGCGTGGAACGAGACGACGAGCAGAAGAATCGAAGTATCCAGTTTTCAGCCTGTGAGTCGACTCATAACAGTCATGAGTCGACT
CATCAGGTTGAGTCGACTCATGACTGTCATGAGTTAACTCATCGCTGGTTTTTGAGTTTTGTCCAGTTTCGGACGAGTCGACTCATC
TCAGTCATGAGTCGACTCATCGATGGTTTCCTGGTTCGTTTGGGTTTCTGTTCACACGAATTCCTGTTGGTTTTATGTCTGGTTATT
TACCAAATTACCATCCACGTTTATATACCTATATAAAAGATTGTTTTAGGGTTTCTAAACTATAAGAGAGGTAATTAAGAGAGATTC
TAATCATTGTATTAGGGTTTAGTGAGAATTAAGAGTTTGTTCTCGATTCTAGTGAGATTGTGAGAGAGAGATTATAATTTTTTCATA
CTCATAATCTAGAGAAGGTAATTTCCTTCGCCATATATTGAATTGTGCTTGTGTTTCTGTTATCCTCTTCTCAACCCACCTTTGATA
ATTCCGCGATCAAAGATGCTCGCATGGCAACTCGTATCAAAGATGAAGATGGAGATTAATTTGAAGGTTTATTTTTCTTATTTCTCT
TTTATTGCTTATTAGTTTAGATTTATTTTCATGCTTGTAATTAGATTTTATTTTCTTGTTTAAATAGCCAATAGGCTAGAACCCTCT
TGCCTTAGATTTATTTCATACTTATAGATTAGATATATTTCATGCTTATAGAGTAGATTTTTTTTTTTTATTTAATTCTTGCAATTTA
TTTTGTAGTTTAGATTTTACAATTTATTTTGTAGTTAGATTTTAATTTCTTGCACTATTCACCTTGAGGCTAGAACCCTCTTGGGTT
TAGTTTTTCTTTTTATTCATTTTTATTTTTTTTGATTCGCCTTTAGGCTAGAACCCTCTAGGGAATCATATTTTTCTAAGAAGTGGA
TTCAATTCTAGATTACCCATATCTTTAATTGAATCCACTATCTTTACATTCTTGATTTTTATTTGTTCTTGATTTTTCCTTCTTGCC
TTGTTGATCACATTTATATTATCACTTCCACTCTCAAATATATTCATTTACACAATCATTTTCATCTCTCCATAATCACATTCACTT
ATCACTCCTATTTGTCTTGCACACAACATAAGAACTGATTTTATATTTTTTCCTACAAAACACCTTCCTCGTGGATCGATATCTTTA
TACTATAACTTGACACGGTTGTGCACTTGCAACATTTTTGGTACATATTTATGCCGCATCAAAGCCGCCAAGATTGCTCTTTATGAT
ACAAATATATGCTTCATGGCTCATGAAGATGAGGTACAATCCTATTCCAATAATGAATCTTTTTATATGTAATGTGAACTTGGAACA
CTAGAAGAATTGAATTTTGAATTTAAAAAATTAGCAAAGAACATTCTTCTTTTAAAAATTTGCATGATTCATGTGACTCAAAGTTT

Fig. 13E

AAGCTTTTACAATCCTCACTAAATGATGTTAGTGCTTTACAAGACAAAATAATTGGAGATCTTGAATTTGAAAATAAACATTTAAGC
TCTCAAATTGAAAGATTAAAAATTAAAGATAAAACTAATTATGCTTCTTCTAGTAATACTCATCACCACCTTAGAAGAACATAGCAT
CATAGATCTCATACCCCTACTTATAAGAAAGATTTTGTTTGCACATATTGCATGAGACATGGCCACACGTCTACACATTGTAGATTT
AGAGATAATGCTTATTATTATGGTTGATGTGGGTACCTAAGGGTGCCAAGTGTACTAATATCCAAGGACCAAAGATTTGTGTATCT
AAAGCTTCTACCTCTTGTTTACATGTAGGGAACATCTCGTACAAGACGTAGAGAGTTGTGGTGCCTTAATAGTGGTTACTCTCATCA
CATAACGGGTGATAATGACTTATTTGTAACTCTATCAAGGATAGAAGGAGGCAATGTCTCCTTTGGTGACGGTGAGAAACGTAAAAT
TGTGGGTAATGCTAATATTGGTAAGATATATTATCCCGTGATTAAGGATGTTTATTTGGTAAAAGGACTTAATCATAATCTCTTAAG
TATTAGTCAACTTAGTGACAAAGGCTATGATGTTATTTTTAAACCGGATAACGTGTATTGTAAGTCTAAAAGATAAAGCAATTTTTGT
TGCCCTTAGAAAGTCTAATGTATATATATTTGAGATGAATGAGCTTTTAGATCAAGATGTGAAGTGTCTTGTCACGGTGGATGGAGA
TCCTTGGATTTGGTGCAAAAGACTTGGTCATGCTCACATGAGGTTAATCTCTAAGCTATCAAAGAAGAACTTGGTAAGAGGACTACC
AAGTCTAACATGCATTAAAGATTCTCAATGTGAGGAATGTACCAAAGGTAAACAAATCAAAAACTCTTTTAAATCTATAAATGAGGT
ATCCACCACTAAACCTTTACAATTGCTTCATCTTGATTTATTTAGTCTTATGCGTGTTGCCTCATTAGGAGGAAAGCATTATGTGTT
TGTTATTGTTGATGATTTTTCACGCTTTACATGGGTTATATTTCTTGCTAATAAAGATGAATGTTTTGAAAAATTCTCTCATTTAGT
AAAAAGAATTGAAAATAAAAAGGATTTGAAAGTTGTAAAAATTAGTGTAGGCTGTCAAAAAAATCACAATAGATAGCTGATCCTCATA
AAAACACCGATGATGGAAGTTACAATCTGACGACTTCCAGAAGGCTACAATTTGAAGACTTTCACGTAGATCGCTGAAGGTTACAAT
CTGACGACCTTCACGACAACCGATGAGAGCTCTAGTTTAACAGCATTCACAACATCAAGAGTTACAATCTGACGACTCTTGTATATC
AAAGAGCTAAAGTAAAGATTATAAAATGACGATCTTTGCAAAACTTCGATAGAAAGAGACTACAAATTGACGGTCTCTTCAAATCAA
GACGTGAAAGTCCTCCCCGCGTACCAGCATCAAGATGCGCCGCATTCATAGCCACGAACGCAGCTCAAATGCAGCTCCAAAAGTTGC
AAACGCAGTTCCAAAAGTTACAAACGCAGCTCAGATTCGCCCGCCAACGCAGCTTCCAAATTGCTATAAACGCAGCCTTCAAACGCC
GTAAACGCAGGTCACATCCAGCTCCAAACGCAGCTCAGATCCGTTGCCAAACGCAGCTCTTAAATCGTACAAACGCAGTTTTCAAAT
TGCTGTAAACGCAGCTCAGATCCGCTGCCAAACACAGCTCTTAAATCGCTGCAAATGAGCTTCCAAACGCTGCGTCCGAGCTTCCAG
ATGCTGCGTTCAAGCTTTTAGGCATTGCGTTTGGACACAGAATTCATGCCAGAACACGGGCCTGCGTTTGACTCGNNNNNNNNNNN
NNNNNNTTCATTCTCTTCTCTTTTGTAATCAGGAAATCCAATTGTAATCGAGATTAAAGGAATACAAATCAATTTTCCTTTGTTTCT
TTTACTGCAAATTTTCCACAAACAAAAGATGGCGACTCCGCTGGGGAAACTAGCTTCTCTGACGAAGAAGTGGTGGTGCAATCCGAT
GTTCATCTCACTGGAACCACGGTTGAAACTCTAGTCATAGAGTTCGATCAAGCCAAGTATGACGGAAGCCCTCTCCTCCGGATCCCTT
AGCCCCAAGGCTATGCGCAAGATCCACAAAGTCTCCAAAGAGACTAAAGCTCCAACTGCTCTAATTGCAGCCGAACCGCCTAAGGAA
GACTGTTCGGACAGCCCCTCCCCCGATGGAGTGGCTTAGCTTCAGCCAAACCTGTGCCAAGACGACAGGTATCCGGTCGAAAGATG
CTCATTGAGGCCACAAACTTGATCAACACAGATGGTGACTGTGCTACAAAGCCTTGAACTGGCTAAGAAGAATGCTGCTCGACGC
AGGAGGAGATCCCTACGACGAGCACATCTCCGAGAATGTCGATCCTTAAGTCAACACGAGCTTCGTGTTTGTGAGCCTAAACACGAC
CCTATGCCCTGCGTTTCTGTTTCAGAATGCAAGTCTCGCGTCTATGAGCCCAAACATAGGCTCTGTGTGAAGAAGACTGAGCGCAAC
CCTCAGGGGCGCGTTCCACAAAATGAACGCAACCCTCAGGGGTGCGTTCCACAAAATAAACGCAACTCTCAAATATGCGTTTCATCA
GCAAAACCTGAAGCTCAGGCATGCGTTCAGTTGATGAAATCCAATACAGAGCCTGGTATATATCGTGACCCCCGGCTCGCTGATGAA
ACGCAATTAGATCGAGGGGCGGATATAAGAAGTTCATGGATCCAAGGCATCTAAACTAGATTCATGTTCACCAAGAGCCAGTCCTAC
CCAATCATAGACTGGGGTTCCAATTCAAACCTCACAATCAGTGAGTAATTCTCTTCGAATCTTTACAATAGATTTGAGAGAGTTCA
TATCAAGAGAAAGACCGATGCAACAAGTCATTCGTTCATTCCAATGTGAACGACTGATTCCTACAGTCCTCTCGGGATGTCAATGTT
GTTCATTTGCGGCCAAACAATTGGTGTTCGACCAATTAATGCATGTTGCCTTGCCCAACCAACAACGACGTTCTCACAGGAAGAAGT
CTCCAGAGACCGAATATCCCGAGGTCACTATCAATGTGATCGGCAGAGGGAAAACCTCAGGTCCTAGTTCCAATGACTCTGAGACAA
GGCGTTCACTGACCGTCAGAGAAATCACAGACGAGTTTGAAGGAGTTTATCAACATACTCAGACTCGAACGGGAGCCATTCCCCCTG
TCAACTATCGGAGGTTAGCCACAGGAACTAATTTCGATGATGAACATTCAGCCATTGCTGAGTCTTAATCATCAAGCTCTTTCATTG
GGCATGAGAGCTTCACCCACATGGCAGAACATTCTGAAGATCTTTCAAAGAGGGTTGCTGAGCAAGACGCCATGCTCAAATCACAGC
AGAAGACTCTCAATGAACTCCTAGACCTGTTGACTCAACTCGTCGCAGACAAGGCTAAATCTCAGAAGACAGAGTTGCCACCTAGGC
AAGAATCCTCCCGGAGAGGAAAAACGTCTTCATCCCGACTTCACACAAGTAAAGGGAAGGGGAAAATAGGCTTGGGCTGGGCTTGCG
GGTGCGGAAAAACCAAAATCTCTCTCTAAAGCTCTTTCGAAAAAGTGTTTTCAGTGGTTGATGACACGGCTTCTGACTAAGAAGCCC
ACAACTTAGAATCTTCCTCTGATGAAGGAAGAGAGACGGAGAACGAGCAGAATCTCCAATCTGCCAAAATGGAAGAATTGGAAGCCC
GCCTCAATGCCATTGTTGACAGAAGTGAGCTCCAAGACGATGGAGTTGCCAGGCCCTATCCTGCCGAATAGGATACAGCCCCTTATC
CTCCCAAGTTTGAGGTCCCGACGATACAAACTTTTGACGGTACGGGTTCACCGAACCAACATATCTATCACTTCAAGTCACAGACTG
GGAATATAATATCAAACGACGTCATACTGGCTCGATTGTTCATTGGCACCCTCAAGGGAGTTGCCTTTGAATGGTTCAGGAAACTGC
CTGCTCGATGTATCCAAAAGTGGGCGGATCTAGAAAGACTCTTCCTGTCGAGATTCTTTGAAGAGGATACGGAAGTCTCCATCCATA
CCCTTCTCGCCACTAAGCAGAAGAAGAGGGAGTCCGTCAAAGCCTTCGTCAAGAGGTTCCGAACCATGGCTCTCCGGTGTTCGTCAG
GTATGACACAATCTACCCTAGTGGAGACCTGTCAGCACAATTTGCAAACCGACCTCCTAGCCCGAATCGGAGTTGCAGAATGTCGTT
CTTGGAGACAACTAATCTCTCAAGGCGAACAGGCTCAAAAGATTATTGTCAGGATCAAAGCTGAAGAACAAAGTAGGCAGGATCAAC
CTGAGCAATCGGACCAAGCCCAATCTTCTCAGTCAGAAGAAGATACCACGACTATTGAAGCTAATCCTCTTCAGTAGGATGGCAGGT
CCAACAACTATCACGTTAATAATTACCTCTGATAGTCAACCTCATTAGATAGTGGCCCATTAGGCGATGTGCCATGTCTACCCTTTT
CCCCCTGCACTTGTTCAAGACTGGGGGTTGGTTTATTTGTAGTTCATTCGATTATGACCAATAAATTTTTTTGAGTTGTCATGTTCA
ATAGAACACCTCCGTCAACCACAAAATCCACCAAAACTATCACGTTAACCGTCACCTCTGATAGTTCATTTCTTCCAAATTCCCCA
CCAATCCTCTTCAAGTAGGATGGCGGGTCCATCATAACTATCACGTTAACAATTACCTCTGATAGTTCATTTCTTCCATATTCCCCC
ACCAATCCTCTTCAAGTAGGATGGCGGGTCCACCAAAACTATCACGTTAACCGTCACATCTGATAGTCCTTTTCCTCCAAATTCCCC
CACCAATCCTCTTCAAGTAGGATGGCGGGTCCACCATAACTATCACGTTAACAATTAACTCTGATAGTTCATTTCTTCCAAATTTCC
CCACCAATCCTCTTCAAGTAGGATGACGGGTCCACCAAAACTATCACGTTAACCGTCACCTCTAATAGTCATTTTCCTCTAAATTCC
CCCACCAATCCTCTTCAAGTAGGATGGCGGGTCCACCAAAACTATCACGTTAACCATCACCTCTGATAGTCCTTTTCCTCCAAATTC

Fig. 13F

CCCCACCAATCCTCTTCAAGTAGGATGGCGGGTCCACAAAACTATCACGTTAACAGTTACCTCTGATAGTCAAACTCATCAGATAAT
GGCCTACCAGGTGATGTGCCTCTGTTCCGACTTCATGGATAGTGTCCCACTACGTGATGTGCCCTTATCTACTTCTTCTTATTCCCCT
GCTAAGTCTTAATCAAGACTGGAGGTTGGTTACTTGGAATCCACTGGATTAAGAGTAACGAATCTTTTACATCGTCAAGTTAACATT
ACACTTCTGACGATCATCATCCCCACAGAGTATGCATTCAACTTGCATCACTCCCAATTTGTCACGTTAACAATATACCTCTGACAA
CAATCAACTTATCAATCCTTGACAATAGGATTATGAGTCCTCAAAATTGCTCAAATCGCAATCTTCCCCAGCAAGACGCTAAGTCTT
CAAAATCTTAGTATCAAAATTCATCGCTTCTGATGATAAACTCACTTAGCAATTCTCCCCAGCGAGACGCTAGTCCCCAAAATCTTG
TTCAAATTACAAGTACACAAATCCTGTCATGTTAATATCACACCTCTGACAACCTACTTATCAATCCTCTTCAATAGGATGATAAGT
CCACAAAGTTGCTCCGATCGCAACACAAATCCTGTCACGTTAACACTAAACCTCTGACAACTCACTTATCAATCCTCGTCAATAGGA
TGATAAGTCCACAAAGTTGCTCCGATCGCAACACAACTCTCGTCACGTTAACACTAAACCTCTGACAAATTCACTTATCAATCCTCG
TCAATAGGATGATAAGTCCACAAAGTTGCTCCAATCACAACACAAATTCCTGTCATGTTAACACTAAACCTCTGACAAAATCAACTT
ATCGACTCTCTTTAATAGAGCGATAGGTCCTCAAAGTTGCCCTGATCGCAACATCTTCCTATCACGTTAATATCACACCTCTGACAA
AATCCACTTATCAATCTTCTTCAATAGGATGATAAGTCCACAAAGTTGCTTCAATCGCAACACATCCTCTTGTCATGTTAACACCAT
ACCTCTGACAATCCACTTATCAATCCTCGTCAATAGGATGATAAGTCCACAAAGTTGCTCCAATCGCAACACATTCTCTTGTCACGT
TAATATCATACCTCTGACAGTCCACTTATCAATCCTCGTCAATAGGATGATAAGTCCACAAAGTTGCTCCAATCGCAACACAAATCC
TGTCACGTTAATATCACACCTCTGACAATCAACTTATCAATCCTCTTCAATAGGATGATAAGTCCACAAAGTTGCTCCGATCGTAAC
ATATTCTCTTGTCATGTTAACACCATACCTCTGACAAATCCACTTATTAATCCTCTTCAATAGGATGATAAGTCCACAAAGTTGCTC
CGATCGCAACATTCTCTTGTCACGTTAATCCTACACCTCTGACAAAACCAACTTATCGACTCTCCTCAATAGAGCGATATCTCTATT
ACCCGTCAAGTTAACATCACACCTCTGACGACACAATCAACTTATCGACTCTCTTCAATGGAGCGATAGGTCCATAAAAATACTGTT
AGGTTAACATCACACCTCTAACAGTCAAACCCCCCAATGAACTTGTTAATCCTTTTTCAACAAGAATAGCAAGTTGTCATTATAAAA
TCCCCAGTGGATTAAAGATTTTCTAGAATTATCCTAGTGATAATAAAGAAAATTTTTGAATTTCACTCTAAGTGAAAATTCATGCCA
AGTTAATATTACACCTCTGGCGTTTCCAACTTTCTTTCAGTGTTTCAAGTAACACAGGAAGAAATAACGACAAAGTCTACGTATTCA
ACATCGTAGCACCAAAATCCATGCCTTTTACGCATGGGGACTTTATCTCGATCCCTAATTAGAGATAAGCCTACGCCTAACACGCG
TTGCCGGTTAGTCTTTTTCCGTAAAAATGACAAAGTCTATGTATTCAAAATCATAGCATCAAGTCTAAGAGGGTTCATTCTCTTAGC
ACAACGTTACATGTGGAACGGACTTAGACAATCCACATGCTAGCCCGACTCAAACGGTAGTCGGTAAAGGCTTATCAAATCCGTTGA
TGGCTGAGGGTTTGCCAAAAATCCTATGCATGTTTGCAGGCCCATCAGCTTAATGGATGTGAGCCGAGACTTAAAACAGATGAGCCA
AAGACAAGTCTCAAAGACTTAGTCAAAAATGCACGGAAGCCACTTCCATGTCTTAAGTCAAAACGTTGAGATCAGACCCGCATCTCA
AGTTCAAAATGCAGGGTCCACCCCCACATTCCAGAAGCAGGATTATGGCGCATACCTTCACACAGGTCCTACGTGGCAAATCCTTTC
ACCAAGATGCCTTCGAAGCAAGTGCAGAGAACAAATCCTTTACAACAAGGAATCAACAGCTCCAAGATCAGAGTTGAAATCCAAAGT
ATTCCGAAAATTCGTCCCAGTCAACCGCGAACTTTCGAAAACTTTGGAGGGGGTTCTGTAGGCTGTCAAAAAATCACAATAGATAGC
TGATCCCCATAAAAACACCGATGATGGAAGTTACAATCTGACGACTTCCTGAATGCTACAATTTGAAGACTTTCACGTAGATCGCTG
AAGGTTACAATCTGACGACCTTCACGACAACCGATGAGAGCTCTAGTTTAACAGCCTTCACAATCAACATCGACAGTTACAATCTGA
CGACTCTTGTATATCAAAGAGCTAAAGTAAGGATTACAAAATGACGATCTTTGCAAAACTTCGATAGAAAGAGACGACAAATCGACG
GTCTCTTCAAATCAAGACGTGAAAGTCCTCTCCGCGTACCAGCATCAAGATGCGCCGCGTTCATAGCCACGAACGCAGCTCAAATGC
AGCTCCAAAAGTTGCAAACGCAGCTCCAAAAGTTGCAAACACAGCTCAGATTCGGCCGCCAACGCAGCTTCCAAATCACTGTAAACG
CAGCCTTCAAACGCTATAAACACAGGTCACATCCAGCTCCAAACGCAGCTCAGATCCATTGCCAAACGCAGCTCTTAAATCATACAA
ACACAGCTTCCAAATTGCTGTAAACGCAGCTCAGATTCGCTGCCAAACGCAGCTCTTAAATCGATGCAAATGAGCTTCCAAACGCTG
CGTCCGAGCTTCCAGATGCTGCGTTCAAGCTTTTAGGCATTGCGTTTGGACACAGAATTCATGCCAGAACGCGGGCCTGCGTTTGAC
TCANTTCAAACACGAGCTGAACGGTTCCAAAACCGTTTCCCACGATCTGAGGGGATCACAACTCCACTCAGGAGTGATTTAAGGGGC
GGTTACATCTCATTAGCCCCACTTAGGAGCGAATTAAGGAGGTGGTTACACCCCTTAATCCCCTATAAATAACTGAAAATCAATTCA
GTTCAAGGGGGATCTGTTGGAACTTCTTGGCTCGTCAACAGGATCCTTAGAGCATTTCTGGAGCTTTGGAGATCGGCAACAAGATC
TTCTTCATCCTTGGCTTATAACCGACTTTCGGTTAAATCAACTCTTTCATAGAGTTTTAAACTCGTTCAGAGTTCTCCACAACGTCA
AATCGTGAGGAGAAGACCACGTTCCAGTGAAACAAGACGTCGGATCGTCAACGAGAAGCAAACTCGACGCGAGCATTCGAGGGAGGC
ATCTCATCGCCACCGTGAAGAACCCAGAATTAAACAAAGGGGAGAATCAAANTTATTCTCTTCTCTTTTATAATCAGGAAATCCAA
TTGTAATCGAGATTAAAGGAATACAAATCAATTTTCCTTCGTTTCTTTTACTGCAAATTTTCCACAAACAATTAGAAGCGATCATGC
TGGTGAATTTTAAAATAAAGTTTTTAGTGATTTTTGTGACCATCATGGTATTACACCTACGTTTTCCGCTCTAAAAACACCACAACA
AAATTGTATAGTTAAACGGAAAAATCGTACCATATAAGAGATGGCACGTATTATGATTAATGATTTTGATTTGCCAAAATATTTTTA
GGCGAAAGCCGTCAACACGGCTTGCTATGTTTTAAAACATGTTTTAATTAGACATATTTTCAAGAAAACTCCTTATGAACTTTATTT
TGGCAAAACTATAAATATTAGCTATTTCCAAATTTTTGGTTCCAGATGTTTTATTTTGAACATAAAAGATCACCATGATAAATTTGA
TTCAAATATTAATTTTGGTGTATTTTTGGGATATGCATCAAGGAGTAAGGTTTATAGAGTTTTCAACAAACGAACACTTGTTGTTGA
AGAATCTATAAACGTTACCTTTGATGAAACTAATGATGGCTTGCTAGATTGTGTGCCTAGGGATGATGATAATATTGAGGAAGGATT
GGAACTTATGTAAGTAAATGACAAACCCTCAACGGATGCACCCAAAGATAGGGAAAGGAACCTTGAACAAAATCAAGAGGAACTTCC
CAAGACATGGAGATTTGCACCGGATCATCCCAAGGAGTAAATTATAGGAAGCCTATCTAAAGGAGTTTTAACTCGCTCAAAGGCTAT
GACCGAGTGTGGTAATGTAGCTTTCTTATCCCAAATTGACCCTAAACGTGTTGATGATGCTTTGAATGATGAATTTTGGATCTTATC
TATGCATGATGAATTAAACAATTTTTAAAGAAATAATATTTGGAAACTTGTTCCTAGACCTAAAGATTTTCATGTTATTGGAACAAA
AAGGTTTTTTAGAAATAAACTTGATGAATTTGGCATAATGACTAGAAATAAATCTCGTATAGTTGCCCAAGGATACAATCAAGAGGA
GGGCATTGATTATGATGAAACTTTTACATCAGTTGCAAGATTGGAGCAGATTAGAATATTTTTAGCCTTTGCTAGCTTTAAAATTTT
CAAATTGTTTCAAATAGATGTTAAAAGTGCCTTTTTGAATGCTTTTATTGAAGAAGAGGTGTATGTCGAGCAACCCCCAGGTTTTAT
TGATCCACTATTTCCTAATCATATTTACCGGGTATAAAAAGCTTTGTATGGGTTAAAACAAGCCCCTAGAGCTTAGTATGCTCGCCT
CTCAAGTTTTCTTATTGATAATAGTATTTTAAAAGGGAAATTTGATAATACTCTATTTATTAGAAAAAGGAAAATAATTTATTTTGC
TTCAAATTTATGTTGATGACATTATTTTTGGTGCCACTAATGAATCTTTGTGCAAGGAATTTTCTAAAGTTATGCAAGAACAATTTG

Fig. 13G

ATGTGAGCATGATGGGAGAGCTTATATTTTTTTCTCGGTCTCCAAGTCAAACAAACCAATGATGGGATTTTCGTGTCTCAAAGCAA
ATATGCAAGAGAGTTGGTCAAGAAGATTGGAATGGAGAACTCTAAACATGCACCAACACCCATGAGTACCACCATCAAGTTGGACTT
GGATGAGAGTGGTGAGAAGGTAGACCAAAAGCTTTATTGAGGTATGATAGGTAGTTTACTTTATCTCACCGCTAGTAGACCGGATAT
TATGTTTAGTGTTTGTGCATGTCATCATTTTCAAGCTTCTCCTAGAAAATCTCATCTTATTTCGGTTAAAATAATTATTAAATATAT
ACATCGCACTATAGAACTTGGTTTGTTTTACCTTAAGAACACTTCTTTTCATCTTTATGGTTATTGTAATGCCCAGTTTGCCGGATG
AAAGGTAGACCGCAAGAGTACGAGTGGACAATGTCAATTTTTGGGTAACTCACTTGTTTCTTGGTCATCCAAGAAACAAAATTGTGT
TACCTTATCCACTATGAAAGTGGAGTACATTGCCGCCGGCTTGTGTTGTGCACAACTTTTATGGATAAAATAAAATTTAGTTGATTT
TGATTTACATTTTTATGATACAAAAATATTTTGTGATAACACTAGTGCAATTAAATATTTCAAAAAACTCTGTTTTACATTCTAGAAC
CAAACACATAAGGTACGGCATCACTTCTTGCGTGACCATGTAGATAGGAAAGATGTTTCCCTTGTTAACATTGACACAAAATCACAA
TTAGCGGATATCTTTACCAAACCCCTTAGTGAAGAAGATTTTTGATTTAGGCATGTGCTTTCTTTAAATACTTGTTTTGATGCCTTT
TGCTTGCTATTGATTTTAAGCTATCGATTTCATAGCTACTTTTTCTTTGTGATCTACATTGTCAAAACATGTTTAAGCACACTGTAG
GCGTCAAATTTGCTTATGAGTTCCCGCACGCAACTCGAGATGGAGAGAAGACGATAAACATCATTATTCAAGTCAAAGAGGATTATC
TGACGGTGACAAGCATATGAAACGAGTCTACGAAGCGTACGAATCAACAAAACGACAGAATAACGAAGAAACGATCCAATCGGAAGT
TACGTTTCACTCACGAAAGGAGAAATTCCACTCGTGTCTCATCCACTCCACGTATGATTCACCTATAGGAAGTTGTAGATCTCTTCT
TCGACTTTCTGACGCACTTTGAATCAAGTCATTCCGAGATTGCACCAGAAAATTACAGCGAAAACAGTCAAAGCGCGCAAAACGACC
CCTCGGTCGAAAACCGAGACACAACAAGTGTCTCAGCCAGCCGAGACACAAACTATGTCTCGGCCAGGGCCGAGATACAGAGAGTGT
CTCAGGCCAGAAAATACTATTTTTTACCATTTCTTCGCCGTTAACCGTCGAGATTTTGGTAAATTATGATCCAACTGATTTGAAGCT
ATCTTGGAACGTGGTTAAGTGATTACAAATAAGGATGAGATCAAATTGGCGGTTCTTAATCAAAAACCGAGCTTCTAAAGCCTATAA
ATATAGCACTAGGGCCTTCATTCGCACAGATCCGAAATTCTCGAGCATCGGCAAAGCACTGTCGAACTGAAGAGTGAGGAGCACGAA
TTTCAAAGAGGAGAAAGAGATCTCGGCAATGTATTCAGCATAAAGAGGAAGAGTTCAAGAGATCTACATCCGTTCATCCATTTTTCT
TGAGATCGCACCTAGCTGTGATTCTCGAGAAGAGTGATTATCTCACTTTGCCGAGATAGTTACTTTAATTTCTTGACTCCTTTGCAG
TCAACGAAATCTATATCTTGATCAGATCACTCGATGGTCCACGGATAAACCCGGCACAGGCAAAGATCCCACATAAACAGCCGAGTGA
TAAACGTCTGTTGTGTGTGTTTTAAGAGAGTTGTAATCTTTTATTTTCATTTTTATTAAGTTCATTGTAATGACTGAAGTTGTAATG
AGTCCACTAATGAAAGAACTAACTTTCCACCAAAACACACACAAGGATACTTAGAGGAGTGGTTGGGAGAGACCAAGGTTAATTCTA
AGAGTGGGTTGCTAGTAATGCCTAGGAAGAGGTCGTAAATCCAAACACTTGAAGAATATGACACGGGTAGGTCAACACTTAGAGGAG
TATCTTGTGGGTTTTAACACATGTATATTATCTTGTTTATCCCATTTTGATGTTGACAAAAGGGGAGAGAAATCTCTCAATTTGTGC
ACATAGATAGGGGAGAGTCTTATAGATAGGGGGAGAACCTATCTATAAACTAAAATTTTATTTTATTCATGCTCTTGAATAATGGTA
GTTTTCCATCATCAAAAAGGGGGAGATTATTAGTTCTCTTGTTTTGATGATGATTTACAAACATCATTATTGGTGTTAATTGCTTGT
TGATTATATTGTGTAGATTATAATTTATCAAGCAAGTTAGTACCAATGTTGGAGGATTGGATGGAATCGAGCTCAACGATGATATCC
ATGGAGGTGCAGGCAATGTGGTGAAGAAAAGCTTTCAAGAGCACAATACATAAGAGAAGCTTCATCAAAATATGAGCAAATATCAAG
ACCAAAGAATTGTATTCATATATGTGAGATGTTTGCATCTTTTTCTTTCTCTCTAGTGCTTGATGTAGACAAGTTATTGAGTTGATA
ACATTTGAAGCTCATTAGGTTCAACACATATTTTCACAAAAGCATTGTTTTTAAACTATTTGAAAAAAGAGTAACTATTCGGAAAT
GATCTTTCAGAAATTCTTATTCTAACATGGTCAAAATCATGTTTATAAGAATTTCCCAAAGTTTTATAATTTTTGGAATTTATTTGA
TATTTATTTTGATTTTACAAAGTCAGATTTTCAACTAACATCAAATTCCTGTATGTACATGTTTTCGGTCGATCGAGCTTTGCCCG
TCGGTCGACTGACCAAAGAAGCTATTTTCATGACCCTGCAGACAGTCATTTGCGGTCGACCGATTTACATTGCACGGTCGACCGATG
ACTGAGGGTCAGTCGACCGGAACATCATTATCGGTCGACCGAACCAGCTCCAGATTACTGAGTCTGCAATGGTCAAATATTCGATCG
ACCGGACATGATCCATCAGTACTATAACGACTAGTTTTTGTACTAGTTGATTTTTAGGATTTGGGCTATTGTTTGGGGTTCCTATAT
ATACCCCATTGCTCTCTTCACTTCAGTAATGATTTTAGCAAGAGAAAAATCTTAAGTTTGGTTTTCTAAGTGTTCTTAAGCTTAAAC
TTTCAATTCTTAATCCTCAATTGTGTTTAAATCTTTGTTTTTCTCAAATCCACACTCCACAACCCTTGAGCTTTACTTGTTCTTCAC
TTGATCCTATGATTCTTTCATTGTGATTGTGTGGTGAGATTGATCTCGAGGAGATCACTTGTGTGGATTATAAAATCTTAAGAGGAG
ATCGTTGTGAAGAAGTTACGGCTTGCAAACCGGCTGTGATAGTGAAGTTAGCATCAGGAGAGGTTGTCGGGGACGTAGGTCGGAAGA
CCGAACCTCATGAACATATCGCGTGTCACTATTGGATAACTGTTATGGTGTTCACTCACCCAAGATACGGGCATTTGTAAAATGATA
CAATAAGAGTTGTAACAAAATAACCTCAAACCCACTTGTGTGGCCCAAGCCGAACAGAGGCCTCGACCTCTCCGACTCATCAAGTCG
ACCTTCTTTTATGCTGACACGAAAGGCGGGATCAACTGACCCTATCGCCGAGGGCGACCTGTTAGACCCTAGAGGGGGGGGGGGGGT
GAATAGGGTTTATGCTAATCTAATCCGATTTTATGCTAATAAAACTAATTAATAAATTATTCTTGCAAGATAGATATATATAATATATT
ATGAGCAAGAATATGTAATATGAACAAAGAGATATATCCTATATGATGAAACATATGCAAGGATATATAAATTAACACAAGGGTAAA
TAATCTAAACTAAAGATACAATTGTGATAGGGTAATATAAACAATACAAACACACAATATGATCACGAAGTTCGAACCTTCCGTCCA
ATATCTCCGCTCCCCACTCCCGGGGAGAAATCCACTATCACAATCGGGTTTTCTACGCTTACCCGAACATTATTTACACCTCACACT
CTCATTCACGGAGTTGGGTCCCCACGACCTACGTCTCTGCTCCTCACCTCGAGGAGATCTCCACTACACACTCTGTTTTCTAGCTAA
CCAAAAACTTTACAATCTCACAATAAGCACAATACAACAAATGATTTGTTCTCTAATATAGATGAGAACACAATGTAAGCTCACTCT
CAATGATACAATCTCACAACCTAAATTATATTATTAATGTAAATACAATAAGCTCAATATGGGTGTGTGTAACAATGAGAATAAATA
AGACTTAACTCAAGAAGAACTAGCAATAAAAATTGATATGAAATACAATAGTAAAAATGCTACGGAAATAGAGTTAAGGAAACTTCTCT
ATAAACACAAAGAGAAGATGATGAAATATTGAAGATAAACTCTTCAACAATTGATGTAAACTTCTCTTTGTAAAACCCCAAACTTAA
AACAAACTAACCAAGCTTAAACCCTTATTAAACTTTTGTTTTAAAAACTTCTTGGTTGATCATGAAAGATGAGAGCAATGGGGTATT
TATAGCCTCCTAAAACCTCAGTCAAAAACCCCAAAGGAAAAGACCAAAAAGCCCAAGAATCAGAAATCTGATTCTGTACCAAAATGA
CCGTTGGGGTGAACGGCGGTCGACCGTGGAATTTTCACGGTCGACTGCGAGCCACTTTCGAGTCTGAAAAAAAATCCAGAAAGTTTT
ACGGTCGACCGTAGCGGTCGACCGTGGGATTTTTCAGACTGACGGTCGACCGTCATGGTCAACCACGAAAGTCTCTGCTGGCTACTA
AGGGGAAAACAAGGGTGGTCGACCGTAAACAGATATATGAAATAACAGGTTTAGAAGCAGTTTGATGATTTTAAAACCCTGTTTAAA
AATATCAAATAAATTCAGAAAAAATATAAAATTTTGGGAAATGATTGTAGACATGATAATATACATACTACAAAAACTGGTTTTCAA
AAAAGACCTCCCAAATAAAAAATATTATTATTTTGCAAAATAGTCCAAAACATGAAAATGTGAACATATGAGTTTTGACATTTTAGC

Fig. 13H

TTAACCATGTTTTGAAACAATACAAAATGATTTTATAGACTTGAAGAAAGATGTAAACTATTGTTATGAAGTCTATAAATAAAGAAT
ATAGTATTTTATCAAAATACACATATAATGCACTAAAACATGATTTCATTGAACTAAATAAAATTGATATTGATAAAATCATATATA
TGCATATAAGTATGAAACAAAAATATGTTTTCTAATTATATTCAATTGTTTCATATTAAAACTTAAAAACTATCAAACTAAAATATA
TATGTATATATATAACTATATATATACAAAACCAAAATGTGTATGTGTGTATATGATTGAGCTTAAAGTACTAACACACATAATATA
AACCTAAAACTAAATTACCCAATCTTGATCTTGATCTTAAATAGCTTGACTTGGTAATCTTACGGATGAAGCTTGAACTTGGATCTT
GAACTTGAATTGCATTGCTTCAACCACTATATCCGCCAACCTCCATTTGATATGATCGTGAATGCACAATTCCATCCATCCTCCAAC
ATGTTGTTTATCTACAATAGATAGATAAACACAACACTAGACAAACAATATTAGTAGTAAATTGTTTGTTAAACATCATCAAAACAA
AGAGGCCAACAATCTCCCCCTTTTTGATGATGACAAATAATTTACAAAAAGAATATATACATGAAAGGAAATGAATATACAAAGTAT
AATATATCATGCATATAAACAAAAAGAATATACTCACAATATTTCTCCCCCTTTGGCAACATCAAAAAGGAGAAAAACCATAAAGAT
GAAAGAGAGCGAAAGCTCCCCCTACAAATAAGCATGGCTGAGTATAAAATAAGTATAGGGATTGCTCCCCCTATCAAAATGCCTTAT
GGAAAATATACAATAAAGATCAAGGCAAATATATGTGAGCAAGCATAGATAAAAAATATGCTAAACACCACTCATAAAAAAAATATA
ATGAGGACACATATAGATATATCATTTATGAAAGAAGTGTCTCATTACACAATTATGAAAACATAGTATAAAAAATAGATTTATGAA
ATCAAAAGAAGAGGAATATGAGAATGCAAAAGTTTTCAAATGAAAACAAATCAACCAAATGAAATCATAAATCAAATTTTAAGTCCA
AGAACAATGTTTGATCAATAAATAGAATTTTTTTTTGTAGAACTTGATCAAACCACATATAGAATACATTATAAGGCACACATAGAT
GATCCATAAGCACAAACACATAAATATCATCATATAAGTGAAGTGTAATGAATTCAAAGAAACAAATCAAAACAAGATTTTTGACAA
AATGCAAGAGAGGAAACAATTTATCAAGCACTTAAGCTTGTAACAACCCATATAAGGACTTTTAGTACCCGGTAAACAAGATTTAGG
AATAAACACCCAATAAATCCGAGGCTTATATAAACGCAAACCTCTTATCAAATCAAAACCAATAATCATTGTATGTAGGAAAAATTA
CAATGAAAAGAATAAAGAAAATTGATTTATATTTCTTTGATTCCGATTACAACTTGATTACAAAAGAGAAGAGAACGAGTTTGATTC
TCTCCTTTGTTTAAAACTGGGTTCTTCTCGGTAGCGATGGAATGCCTCCTTCGATTGCTCGCGTCGAATTTGCTCTCCGTTGACGAT
CCGACCGTCTCTTATCTCGTGGGAATAATGAACTTCTGTGGAAAGTTTGATGTTTAACTCTGAATGAGTTTAAGAACTCTGAACGAG
TTAGAACTCTGTGAATAGAGTTGTTAGAACTGAAAATTCGGTTAATGATCAAGCCGTTATTCTATTGTTGAAGAATCCTCTCAGATT
TGATCTTCTGAGCTTGATTCAAAAATCCTATCTCCAAGGATTTCGCTGCTGCTGTTGAATCGCCAAAACCTGAGTGGTTGAGATCTT
CCAAATCCGATCTTTGCTCACTCTTTTTTTTTTTTTTTTGAACTGAAAATCTCCAACCGTCAGCCTCCTGTGGTCGATCTGAGCCAAG
AAAATCAAACCTTTAGCTCAGTTGAGTTTGTTAAGTTTTTATAGGGGATAGGAGGTTATAACTGACCCCTATATCCACTCCTACGT
GGGCGAAAATCCCTCAGAACGTGGGATAAATGGTTCTGAAACCGTTCGACTCATGTTTGAACGAGTCAAACGCCCAATCTGGCGTTC
AGAACCCAACTTCGCCTCTTAGAATTGAGACGCGAGGTTGGGTGTTAGCTGAATATCATTGAACACGAGGGTCGCTCGCGTTTTGGC
TTGATGCCTGCTTGGAAACGCGGGGCTCGGTGTTGGTTGGACCCCTACGAACGCGAGGGTCACTCACGTTTGGCTTGTATCTTAGAG
ACGCGGGGTGCCTTGGAAACTCTGGCGCTCGCCTGCACTTCACAAGTTGTAACGCGGGGATGACATCCGTGTTTTCAGAAGGAGCTTT
TTGACTTGTAACTTCTTCTGTGAAGCGTTGCGAGGACCGTTGTTCAGTAATCCTGGCTTTAGCTGTTGTAGGGTATGAAAGTCGTCA
GATTGTAACTTTCACCGTAGATTGTGAAGACTGCTGAATAGAGTTTTCATCAGTCGTCGGAAGTGTCGTTGAATTGTAACTCTTCTC
GATCTTATGTGAAAAGTCCTCTATTTGCCGCTTTCGATTGTCGACCCGAAAGCTATTTGATTGTAGCTTTCATTGTGAGAGCTTGAC
GGGAATCAACATCCATAGTGTTTTTGAAGATGAATATTTGCCCACAGCTCTCTACCAAGCAACTCACCGACTTTCGATTATCGGCGC
GAAAGCTATTTGATTGTAGCTTTCGTTGTAGGAACTTGACGGGAATCAACATCCATAGTGTCTTTAGATGGATATTTGCCCACAGCT
CTCTACCAAGCAACTCACCAACTAAGTCCAACCTTTCATTTCTAAAATCATTACACTGCTCATCAGCATTTCCAATAATTGCTAATA
TAATATTAGTCGTGCTGTTGTCGCAGCCATCAAGATCAATCATCTCAGAAATGAGGTCGTGTTTGTGCCGATTGTGGAGTTGCGGAT
GCAGTGATTAGAAAGTCGTCTGACTGTGACTTCCCTTATCGGAGCTTGATAGGGGTCAGCTATTCATTGTGATTTTTAGACAGCCTA
CAGAACCCCCTCCAAAGTTTTTGAAAGTTCGCGGTTGACTGGGACGAATTTTCGGAATACTTTGGATCCTAAAATTTAGTGGATTGA
TTGCTCCCTCCGTCTGATCGAGCCAGATGATTTCACCGTTGTTAGTTGTAATCTATCTGTACTCCTCCAATAGACTCCCCAGTGGAG
TCGTTGGTTTCTTCCCGGCTTTGGTCGCCTTGACGATTGCTGTTAGCTCTTCTTTTACTCATCTGGGGCTGTGTCATAGCCTTGGTA
GTCAAGAAGCTGCTATCATAGCGGTCCAAACACAGAGATAATTTCTGCCTTTGGGGATTGGAACGCGGGGGTGAGCCCAGCGTTGGG
AAATTTGAACGCGAAGGTGGGCATCGCGTTTGGAAGCTCAAACAACTCGAACGCGAGGGTCGAGTTTGGGCGGGCTGATGGCCTCGA
ATCCTGTCCGTTATGATTTGACAGCTCATAGCTGTCTATAAATAGACCGCTAGAGGTCAAATCAAGAGTCATTCGGCTCTTCTTGAA
ATTTTAACGAAAAAATTTTCATTCTCACCTCCGACAAAACGCTGTACACCTCCTCCGACGAGTTTCAATGGCACCCAAGAAATCAGC
CGCTTCCAAGTCCGATGCCGCTGCGGCTCGAGGGTCGGCATCGTCAGCGTTGGTCGGCGGCGCTGCTGCTCAGGCGGATGTGCCGCC
CCAGCTTCCTTTGATTGGTGGTGAGTATGACCTCCGTGGCCATTAAACTTGCTTCGGCAAGTTCTGATCTTGAGATCAACGAGGAAA
CTCGTTTCAATAACGCGGGGCTGGACTCCCTCGTTTGGTATTTCTGACGCGGGGTTCAACCTCCGCGTCTCAGATTTTTGAGGCGGG
GGTCGACCTACGCGTCTGAACTTTTTGACGCGGAGTTCATCCTTGGCGTCCAAGCTTATCTGACGTGGGGTTCGGCCTTCGCGTCTG
AACTTATCTGACGCGGGGTTCGTCCTTCGCGTCTGAACTTATCTGACGTGGGGTTCGTCCTTCGCGTCTGAACTTATCTGACGCGGG
GTTCGACCCTCGCGTCTGAACTTATCTGACGCGGGGTTCGACCCTCGCGTCTGAACTTATCTGACGCGGGGTTCGACCCTCCCGTCT
GAGTCTTGCTTTTGAGTTATCTAACTTTCTTCTTCCTTTTGCAGTGCGCCATACCAGTGAACCCCTTCTTTTTCTCCACCATTTTGG
GCATGAAGGTGGTGCGGACATGAACATTGCTTTCAGCTCACGCCAAGAACTCCCCGTTTTCCGAATTAGGGAGAAGAGTCACGTAGA
AATAATTACCCAAGCTTCTTCTGACACTCTTAGGACATTGGTTACGGACGCCCGACTTGAAAGCCCAAGCCGTAAGCCAATAGTCAA
ACCTGGATATCTTTTCGGGGACTTTGTTGACTTCGACGCCAGCACTGCTTATGATGGGGACTATAAGTGGTTGCGGAAAGTTGGGGA
CCGCAACCTTTTCTTGCCCAATATGGAGAGGATGTTCCCCATATCTTATTTCCAGTGTGCTTCTGTCCCAAGGCATATGGATTGGCC
CCTGGTTAAGAATCAAGATGGGGTTGCTCTCGGGACTTTGACTTTTCACGGGTCCGCACAGTTGGTTATAACCGGCAGGTGACAGC
TTTGCGGCCGAGTTTATTTGCTAAGGAGTATCCCCTTGGTGAAGTACCCAGCCCAGCGAAGACCTTTGTTAAGAGATTTTTGGAAAA
GAAAGCAGAATTCCCCGCACAAGGATTTAGAGCTCCTGGTTGGGTTCATTCTCCAGTGTCAGGGTGGTGGGCCCAGATGACCAAGTT
TGTTCTGGAGGAATTGGAAACCCCTCTTGCCCAAGCTGGATTGCTGATTCCAGTGTGGGCTACTAAGTTCGGGATTATTCAGAGCCA
CTTTCATTTCTTTTCCATATTGGAGAAGTATAGTCCCGAGACTTGCACTTTCTTCACCCCTGTGGAGGAGTTAGGCTTCCTCTTCA
CGAGATGCACGAAGTCTCAGGTCTTATTCTAGGGGATTTACCCTATGAAGAATTTGTTCCGGGATCTACGGAACTTAAACTTTTGAA

Fig. 13I

GAAGACCAGCCCAGAAATTTACGCCACTCTCTGGGAAGTGATGTGTCACTTCCATATCTGCATGCAGCTAACGGGGCTCGCGGAAG
CGGCATCAAACAAGTGTCTTGGGCAGAATATTTATTCCAGAACTTGACCACTAAAGGAGGCTCTGTGACCCGATTACCTGTCAGTAC
TTTGGAAGAGGTTCAGGCTCGTATTGACGACGCTACCCCCATTACACCAATGAGGCCAAGGAAGATGTTTTCCCGGCTCACACAGAG
TTTGAGAGCTTTCATTATCAAGCTCTGATTCCCATTTCCAACGCGGCGTTGCTGGCTGGATTCTTGATGTTGTGGCTCAAGCGTTGC
GTCGTTCCTACCAGGCCGGTCGATGCCCTTGCTATTGAGGTGGTCTACCCGGCTGTTCTCTTGGCACATGGGAGACCTGTGAGCCTC
CTCAGCGCCATGGTGGGTTGCTTACAGTATGGACTGCGGGAGTTGGCCTCTGACTTTGTTGGTGTTACAGAGATGGAGTCTGAGGGT
CACAAGACTTTCAAAACTCCCAATCCCAGGGTACCAATGCCATATGCCTATTTGATGGCTTGGTACGTGCTTCACTGTCCTACTTTG
ATGAGTGCAGCCTCTCCCCCGGAAGACTCCTTCATCCCATTTGTGCAGCGACTAGAATCTGCGAAATGGGTGGGGGTTACATGGTT
AGAATTCGCCAAATCCTTGCGCGAGACACCAACTTCCATATCTACCGCTGTTTCCCTGATTTCGAAGGCGGTGTCTATGGGCCAGAA
TATCAGGATACGGCAGGTCCTAATGGATTCACTCAGCTGAGCAGGGGTGTTTTCCATTGGCTTCTATCCATCAGGCCAGGCTACCTG
ATCTTTCGGCAAGGCGTCAACTGTTTCGTCGAGCCTTACCAACCCTATAGGTTTGCTCGCCAATTTGGGTATGATCAGTTGTATATT
GGGAACCCTCGCCCTCAACTCTCAGTTATAGATAACTTATATGAAGGAGCCAGGGCCTGGTATTATTCTGTAGCAGGCTGTACCAAA
GCCGTCTTCAAGCTTCCCCACAAAACTGCTAACTCCTATACCTCCATCAGCTTCTGTAATTGGTATTACGCCGCTTCTCAGACTCCC
AACTACAACTTGAATAAATCTTGCCTGAAAGACATTAGGCATATGTATAATTTAAGGAAGGGGTCCAAGACATCCCGCTTGAAAGGG
ATCGATGAGTTTCTGTCCATCGAGAATCAATCTGCTAGACAAGAAGAGGAACAGACAGCTGAGCCTGCTCTAGGGGAAGAGCAACGA
GTGGTTGATCCTCCCGTGACAAGAGCAGCGGGGAAAAGAAAACTTTCTGCTGATGAAGCCGGCCAGTATGATAAGCAGATCCGTCAG
AAACTGCTGGTGGATTCTCCCCCCAAAGGCCAACAAAAATCCAAATTGATGGCTGAGGCCATCAAAGCTGCTAAAGATGACGAACCA
CAGGAATCATCTGTGGCTGGCCTGCCACACAGAGCGGGACTTCGTTCTCATGGCCCAGCTCTGTCGGGCGAAGTTTCTTCTTATCAT
CCTCCTGAGGACGAAGAAGATGAATTAATGGCTGCAGATGCAGAGTCTGCTCCGGTGATGGATCTTCCTAGGTCTCCTGCATTGGAA
CCAGGGGGTCTTGAAGATAATCCATCTCCTTCTCCTTCAGCATTAATGTCACAAGCTGGTGATTTAATGCCTAATCCTACAACGGGA
CCTATGAAAAGACCAGCTGCAGGTGCAAGTCTCCCTGAGCCCTCAGCTACCCGGGATGATGAGGAGCGAGTTGATTATGAAGACTCC
TCGATTGGTGGTGCAGCTGACGAAGATAGAGATGATGAGGACGCTGACGTTGGCAACATGTCAGGTGGTGGTGAAGATGACGAAGAG
CATGATTCCATAGATGACGTCACCACTTTTGATGATGACGCTCCCAAGGTCCCATCCGATAAAGCATCTGGTTATACTCCTTTCTAT
CTTAGCGGTAAGCTTGGTTTGTTTCGACTTCTTCCACATGCTTTCTCCACGTTCCGACCATTTTTTCGTGCAGGTTCACCTTCTCCA
AGGACTACTGCTGCTGCTGCTTCCGAGCCAGAACCTGCTCAGGTGTCGGCTCCTTTAGAAGAGCAACATTTACCTGGCTCTCTTACG
GCAACTGCTTCACCTGCAGCGTTGCCTGAAACTACTGCCGCAACTCCTTCACCGGAACAGCAGCTCGTGCAGGTGCCAGCTTCTATG
CAAGAGCAACCCCTGCCTGACTCATCCACCGTAGCTACTTCATCTACAGCATTGATGAAGATCTCGCTTGCGCCCACAGAGGCCGGA
CCAAGCGAATCTCCGGCGAGGGCAATGATGGCCTTGACTTCAAGCCCTTCGCAATTGAATATTTTAGTTGCCTCCGCGACTTCTACA
CCCAAATCACTTGCCAATCCATATTTTAGCATGTCAACTTCTGGGGTTGTAGAGTCATCTTCCATTGCTTTTTCTAGTCCAACGGAC
GCTCCTGACTTCCTCCATATGTCCTTGAGCTACTTAAACAGTCTCGTGCGGAAGGTGATTGAGGTTGTCACAGCTGGTCGAGCCCGC
TTCGACTCCTTTAAGTCTCTCTTAGAAGCAGGCTTAAATGGGGTCAAAAGTGTGGGCAATGCTCATTGCTTTGAACGTTGTTCGGAA
GCCATTTCCCACTTAGAAGCCCGACTCAAACATTTGGAAGCCCACAGCCATGAAGACATTCATACACAGATCGTGTCTACTTTTGCT
GACTTCCAGGTTGAGGAAGTGACTCGCCGTGAGGCAATTGAGCGAGGCCTGGCTGAAAAAGAGCTTCAAGTTACGCAGTTGCGGGAA
CAGAGCGATCTGAGACAAAAAGAACTGGAACTCTCAACTGCTTCTTTGGACCTCATTTGCACGAAACTTGTCGAAGCTGAGGCGGAG
GTGTTAAGGTTGAAGGCCGAGCTTTCTCGAGAAGAAGCCGTTGTTAACACCCTTGGGGCCAAGAATGCAGACACTCTTTTGAACTAC
CGTAAGGAAGCTCAGGCTCTTGAAAGAGCGAAGAAGGAGGCAGCCGCTGAAGTGGCACCCAGTGAGGATGAGCTGCGGAAAAAAGCT
GAAGCCTTTGTGCGAGCCAATCATGAGGAGAAGCTCTCTGATGCCAAAGCTCAACTTGCTTCTTTTGACTTGAACTCGTACTATTCT
TTTGCTTAAGAACAGCTTTGTATCACTTCTTTTGGTTTCTGAATAAAAACTGATATTGACTTCTCATTGTTTCTTGCATTTATTAT
GTTTTAATTTTAAATACAAGTCATGAGAAATGCCTGAGATGTATTCCTGACTTAGAATAGATCTCCACAATGGTTCTGGTGCAGAAA
ACTCTCTTTATTATCGTTTAAAATAACTCTAGAAAGTTTTAAACTGCTGAGGATGAATATTCCCATAATGGGTTGACTAGTAGATT
TCTTCCTATGTTATTTCTTGCTTTGAACACTGAAAGAAATCTATAAGTACCAGAGGTATAGTTTCAACTTGGCATGGGATTATTGA
TATTGTCAGAGGTGTAATCTTAACGTGACAACTGGATATTACGATCAGGGCAATTTTGAGGACTTATCGCTCTATTGATGAGAATC
GATAAGTTGATTTTGTCAGAGGTGTGATTTTAACGTGACAACTGGAATATTGCGATCAGGGCAATTTTGAGGACTTATCGCTCTATT
GATGAGAATCGATAAGTTGATTTTGTCAGAGGTGCGATTTTAACGTGACAACTGGAATATTGCGATCAGGGCAATTTTGAGGACTTA
TCGCTCTATTGATGAGAATCGATAAGTTGATTTTGTCAGAGGTGCAATTTTAACGTGACAACTGTGGGGGAAGGATATTATAGCATC
TCACTGGGGAGAACTGCTAAGTGTTTTACCATCGGAGCGATGAATTGTGATACTTGTGATTTGGACAAGGTTTTGGGAATTTTGTT
AACCCGCTGGAAGCAGGTTATTTATTGCTCTGCTGAGGAGAGCTAATAAATTGACAATGAGTTGGAGACTTATCATTCTATTAATGA
GAATTGATAAGTGGATTCTGGGGTCCAATATTAGCCCGATGAGAATTTAGATTCTGCTGATGAGATACAGAGGTTTTGACTAACTCT
CTGTTAAGAGGGCTCATGACTTTGAGGGATAAGTGTTGTGTTTGATGACACAAATGTAGATTCTTCATTTAGAAGAATTATAACGCT
GAAGTGACCTTCGCGTTTGGGATTCAGAACGCGAGGTTCGGGCCTTCGTGGCGCTAGCCTGAGCTTTGCACTCGGGAAATTGAACGC
GATAGTGAGCTTCGCGTTTTGAAGATGGTTGGGATTCACTCCTAGAATCCTGTACCATCTTAACAGCTTGGCGGCTGTTATAAATAG
ACCTGAATGGTCACATCAAAAGTCACTTGACTTTCAAAACTTTCGGCTATTTCCAAGAACGAGAACTCTCGTTTGACTATGGCGAGA
TCTCCGACAAGCTTCGTCTCCCTCGTTCAAAGGAGTTTCTTTCGATCGACTGCATCAATGGCGCCTCGGAGGACGGGTTCGAACTCC
AAGAAGGTCGCTGGAGCAACTTCCGACATGCCGTCGGCTGAGAACGCCGGCGGTGCTCTTGTCCATGCAGGAACCTTGCCATCGACA
TCGCCGCCGCAGGGGCCTCCCTGTCGTGGTGAGTGCTGACCGAAATAACTTGCCATGGCAAGTTCTTTGAAAACCCTAGATGGGTTC
TTGATAACGAGGAAGATGACTCGTTCAATGAAAACGCGGGGTTGGGATACCTTATGGGTCTCGACCCTCGCGTTCAACTTGTTCAAC
ACACGGTTCGACCCTCGCGTTGGAGAATTCTGACGCGAGGCTCGACCTTCGCGTTGGAAATTTTGACACAAGGCTTTACCCCTTTGT
GTTTCAGACTCTGTCTTTATGTCGATAGCTCGCTTCTAGCTGCTAACTTCTGCTTTTGATTGTGCAGTGTTTCTCCCAAACGTGCCG
CTTTCACAAGAGCACCATTTCGGATATATTGGTGACCTGACCCGAATGAATTATTCAGTCTTTAGAACAGGATTCCATTGTGTACT
TTTCCTGATTCGGAAAGAGCGGAAATGATTAAATTCCCTCAATGCTCTACTCTCAGGATTTTGATAACTGACTTGACTTGGAGACC

Fig. 13 J

CCTGTTGGTCATGCCCAGTTTCCCAAACCAGCATTCATATTTAGAGATCGCGTACCAGTCGATGACCATCTCACATATGTGGAAGAT
TCGAAGCTGCTGTGGAGAGCTGATAATAGCTTCTTATTCCTCCTAAACATGAAGAGGATGTACCCTCTCTCCTACTTTTTGAATATG
AGCTGCCGTCGGGGTTTGACCTTCGACATAGTAAAGGAGAAGGAGAACGTGTCGCTTGGATTTGGTCGACGGCTCGTACAGAAATC
GGGGAACAACTCAAGGGGTTAAAACCTGGTTTGTTTGAGAAGAAAGAGCTGGTTTCGGAGGTGCCACGTCCAGCGAACATTTTTATC
CGCCAATTCCTTGTAACTCAGGGTGAATTCTCTACCCAGACGTTCAGGTCCCCTGGATGGGTCTGTTCTCTGGCGAAGGAGGTTGGT
GGACCCGCATGGTTGACTTTGTTCTTGAAGAGCTTAAGGACTCGCTCGCTCAATCGGGTCTCACAGTTCCTGTGTTAGCTACACGAC
GGGGAGTCGTGCAGAGCCTTCACAACTTCTTCGCTATGTTGGAGAAATATAATCCTGACAGCTGCACATTCTTCACGCCTGCTGGAG
AGTTAGGTTTTGCTCTTCATGAAATGCAGGCAGTGTCGGGGCTGTCACTTGGAAAAACGCCCTACGAGGGGTTTATCCCTACCACCG
AGGAGCTTTCCTTACTGAAGGTGGCACACCCGGAAATTTATGCTACTTTTTGCGAATTGATGTGCCACTTCCACATATGTGCCCAAG
TCTTTGGGATGCGTGGAGGGGTATTATGCATACCACATGGCCAGACTACCTCTTTCAAAACTTAAATCGGAAAGATGTAGCCGTAT
CCCGTGTCGCAGTTGTCTCACTTAAGGACGCCAAGGCTCGGATTAAGGCTCCTGGTGCTACTTATAAGACAGAGCATGCCGAGGATG
ATTTTGAAGCTGGTGTCGAATTTGAAAGTTTCCACTACCAAGCCACAGTTCCTATCTCTGACACGGCTCTACTTGCAGGCTTCTTCA
TGATTTGGTTGAACCGGTGTGTGGTACCGTCAAGACCAATAGAATCAATATTGGCTGAGGTTGTGTACCCAGCTGTTTTCCTAGCGC
ATGGGAGACCTGTGAGTCTCCTTACTGCTATGGTTGGCTGTATCCAGAACGGCCTGAGGGTATTGACTTCAGAACTTTTTAGTGCTT
CAGGACTCAAAGCTACTAAGAAGAAAGCTGGAAGGCTCCTCAACCACGTGTACCTATGCCATATACATATTTAGTGCCTGGTTCG
TGTTGCATTGCCCTTCCTTGATGACGGGAGTGCATGAAGGGGATGATGCTTATACTCCCTTCGTACAAAGGTTGGAGTCGGCCACGT
GGACTAGTTCTTATATAGTCAGGCCTCGACAGCTTCTATCCCGGGAAGATAATTACCGGTTTTCTGCTGTGCTCCTAGCTTTGACG
GAGCTGATGTGGAGAATGCCCATTTCATGGACTTGCTTTTTGAAGGCTCATCTTCTTTGGAAGAGGGTACATTCAGCTGGCTTCTTA
TGATCAGGTTGGGCTACCTGGTCTATCGCTCGCCGGAGAAGTGCATAATTGAGCCTTACATGCCTTCACGGTTCGCCAGACAGTTTG
GATATGACCAACTCTATGTTGGTAATCCTAACCCGGCGTTAGCTCAGATTGGGAATTTGTATGAAGGAGCTCGTGCATGGTACTTCT
TCTCTGCCGGGGGAACCCATGCGCAATTCACTTTACCCAACTCACCACCCGGCTGTTCTGCTGTTATGGATTTCCGCCAGTGGTTTG
CCGAAGCTTCTCATGTCTCGGAATATGACGTTTATACCTCATGTATAAACGAGATTCGGGAATTGTATCGTTCACGGAGCGGTTCTG
CGAGTACTCGTCTACCAGGGATGGAAGAGTACCTATCTTGTGAACAGGAAGCGACCGGAGCCGTTAAAGCTCCTAAGGACTTGTCTA
CCGTATAACCTTCTGAAGAAGAGGTTCCTACGGGAATTGAAGAGGGAAAGCCAATTGATGATTCTCCCGAAGAAAAGACAACTGAGG
AGATTCCTGCAGAAGAGCCCGTTCCTACACCTCGTTCTCTAAGATCGGGTAAGAAAGCTCTTTCTGCTGCTGAGCAAGGTGAGTATG
ACAGGAGAATTCGCAAGCGGATACCTGTCATGGCCAAAAATTCCAAAAAGGCCAAATTAATGGGGACTCGATGAAGTCTGCACTCG
TTGAGCGTTTAGTTGACAAAGAGGACGAAATGCCCCAATCGATTCCTTCGATTCCTGGGACGATAGAGCTGGAGAGGCCCTTCTT
CTGAAATTGCTCCAACACCTGTTCAGGACGAACATACGGTTTAATCTATCCAACCCTTCCTCCTCCACGCTCGCCGGCTCTGAAGA
AATCGATTGATGAACTGGAACGTTGGATGCAAACAATTATTAATATTATCAGTGTTGAGGGGCTTCTCTTGAAGACTGTGCCGTCTA
TCTTGGGCCAATGTTTGGACGACATCAAGGCTAAAGGGGATGCATCCTGGACTGAGCACTGCCAAGGGGGAATCACTCTTTTGATGA
CAGAATTAGCAGTTTTCAGGGAGCTACAGCGCACCAATCTAGATTCTGAAGTGGAGCCGGCTCTTTCCTTGGCGATAATCTCGAGGG
CGCATCACCCAGGGGATCTTCGCAAGGAACTGTCTGATAAAAAGGCCCGCATATCAGCTTTAAGGAAGCGGCACTCTGCAACATATG
CTAAAATCAAAGGTGTTGCTTCTGATATCCGTGGTATCGAAAAGACTATCGCTCGATTGGAGGCCGAGTTGGACCAGAAGAAAGCCC
AATTGGCCCACTATGAGGATGTCAGAAAAGAGCTTGAGCATCAAAGTGGCCAAATTTATACGAAATTTTGCCGTACACTCCATGCGG
CTGAGCGAACTCGTAAGGACATTGTTGCTACCCTTCCTATTGAAGCAGAACTCAGAAAGGAGATCGAGGGACAAGTCCAAGCGGCTC
ACCGGGAGAAACTTTCTGCCCTTCAAGTCTAGGCTAAAAACCCTCAAGTTAATGAAGCCTGATGTTTAGCCCTTGACTTGTTCTTGGC
TAAAGAATTTCGTATCATTTTCACTTTGTTTGTCATTATTTTGTGTTTAGATTAACAACATTAAATGAAAATGATATCATTTTGCCC
TGTATTGTCTTCTTTTGCTGAAATCTGGCTCTAAACAATAGAGAATAATGCTAATACTATCGAAATTCTCTTTTTCATTTATTAGAA
TAATTCTAGCAAATTACAGTCGTCAGAGGTGTAGTGTTAACATGACGAAATATAAAACAGAATTACACTATAAATGGGCCACCCCA
GCCTGATTTAACTGGGTTTAGGGGGCCGCATGATTTACGGGAAGTATCTCTTAAGGAACTTCCCATTAATTGGCATCATGAGCCTA
TCTCCTTCTTGGTTGATGAGGCGATATGCTCCGTTCGAATAGACTGATTCTATTACGAATGGCCCTTCCCATTTAGGATTGAACTTC
CCTCTGGTTTTGTGTGTCATCACCATGGCTCGTCTGTTGGCTAAAACTAAATCGCCTTTCTTAAAAATCCGTTCCTTAACCTTTTTG
TTGTAGGCTTTGGAAATCCGGGCTTGATATAACTCGATCTGTTGTTGAGCCTGAAGTCGCTTGTCGTCTAAGGCTTCAAGTTCTTGC
AGACGTCGTTGATGCTTTTCTTCTTCTGTTAGTCCAGTTGTGATACGGACTCTCAGAGAAGGAATCTAGATTTCCAATGGCAATACA
GCCTCACAGCCGTATACCAAAGAAAAAGGTGTGGCTCTTGTAGAGGTCCTTACCGTAGTGCGGTAAGCCCACAGACATTCACCAAGT
CTTTCATCCCAATCGCGCCGGCTTTTAGAAACAAACTTTTTGAGAAGCTTCACTATGGTTTTGTTAAAAGCTTCTGCAAGACCATTC
GCTGGTGGATAATATGCCGTGGATGCAACACTTTGGATTCTAAATTTGTCACAGAATCTCTAAAACCCAAAGCTGACGAATTGTGTC
CCGTTGTCGTGAACTATTCGCCTCGGGACTCCAAAACGGTAGACAACGTGATGCTTGATGAACTTGATTACGTTTGAAGTCTTGACT
TCTTTTAACGGGATTGCCTCCGCCCATTTGGAGAAATAGTCGGTTACGGCTAAAATGAACCGGTGTCCCTTGGACGTCGGAGGGGAA
ATCGGGCCGACGATATCCATACCCCACATTTCGAATGGCCAAGTTGCTGATGTGGGGTGTAAGTTCCCTGGCGCTTGGTGGATGAAG
TCTCCATGAATTTGGCACGCGTGACAACGTTTAGCGTAATCAACCGCGTCTGAAAACATCTTCGGCCAATAATAGCCGATGCGTCGG
AGTCGATCTCCTAATTTAGCTCCAGGCTGATGAGCTCCGCACTTTACGCCATGAGCTTCCTTGAGGGCCTCTTTTGCTTCTTTCCGG
GAGAGACATCGAAGCAAAATTCCATCATGCGATTTACGATACAGGACTTGAGAGACTGCATCATAATAAAATCGGAGGGCCTTTCGT
TTGATAGAGGCCGCTTCTTTAGGGTCATCTGGCAGAATTCCATACGGCATAGTCGATATACGGGAATCGCCAATCTCTGGATTCAAA
CTCCATAGAAGTTGTACAGACTTCTTCTGACGTCGTCTCGTCTGGGTTTTCCTTCATGGGGATCTTGGAAGAGCATAATTTCCATCC
CGCGACTGGAATCGTTGTTTCAACCCCCGGTGGCAATGCTAATGAAGTTGCCAAAGAGGCTAAAGCATCTGCATACGCATTCTGAGC
TCGTGGTATATATTCGATAAAGAAACATTCGAACTTTTGAGCTTGCTTTAGCACCGCGAAGTAATACGGGATTAGATCCTCGTGACG
TACTTCGTATTCCCCCGGACTTGGTTAACAATGAGTTGAGAGTCACCGTAGGCCTCAAGATGCTGAATATTGAGTTCTTCAGATAA
TTGCATTCCCATTAGCAGAGCATTATACTCGGCTACATTATTGGTGCAAGGTTCGATTAAGGAGAATCCTCTGGGAATTACATGGCC
GTTCGGAGAGATTAATACTACTCCTACTCTCGCGGTGATTGCTCCATGAGGATTTGCTCTGGATGCACCGTCGAAGAATAACTTCCA

Fig. 13K

CACTTGCGTAGCTTCTTGAGTAGCGCAAGCTTCGCCGACTTCGTCAGGTAACTCTTCATACAACTTAGATGCTCCCGATACTGGATG
ATCAGCTAAGAAGTCGGCTAGTGCTTGACCCTTGACTGCCTTTTGGGGCATGAACTGCATGTCGTACTGCGACAAGAGAATGGCCCA
TTTTGCAAGCCGGCAATTCAGAGATGCTGGTTTCGTCATCAGCACTCTTAAGGGATTCACCTTAGAGATGACCTGAATTGTCTGTCC
AACTAGGTAATGTCGTATCTTTTGAATGGCGAATACCAAGGCGAGACATTTCTTTTCGACCGGATTGTACCGATGTTCGGCTCCCAT
CATAATCCTGCTCAGGTAATAGATGGCTTGTTCTTGACCTTGATCATTGTTCTGGGCTAACAAAGCACTAAGAGAATGATCCATGGC
CCTCACATATAACAGCAATGGTTTTCCTGATATCGGGGCCACGAGAACTGGCGGTTGAGTTAGATATTTCTTAATCTCCTCGAATGC
TCTTTGACATTCCGCATCCCAAACAAAGGATATTCCTTTCTTCATAAGCTTAGAGAAAGGTTGGCAGCGCCCTGACAGATTTGATAT
AAATCTTCGAATGTAGGCCAGTCTACCTTGCAAACCTCTGAGCTCTTTGAGATTCTTCGGAGGTGGCATGTCTTGGATGGCGCGCAC
TTTCTCTGGATCAAGAGAGATTCCCCTGGAAGTAACGATAAATCCTAGGAATTTTCCACTTGAGACTCCGAGGAATGATTTTGTCGG
GTTCATCTTCAGCTGATGTGCTCGCATGATCTCGAACATTATCTTCAGATCTGTAAGATGATCACCTTTACATTGGCTCTTTACCGC
TATATCATCAACGTAGCATTCGATCTTCTTTCGGAGGTGTTCGTGAAAGATTGTGTTCATTGCACGTTGATAAGTTGCACCTGCATT
CTTCAGGCCGAAGGGCATCACTGTGTAACAATATACCCCCAGCGGTGTTCTAAAAGCAGTATGCTTTTTGTCGTCCGGGTGCATCTT
GATCTGATTGTACCCGGAGAACCCGTCCATGAAAGACATCCTTTCATACCCGCAGGTGTTGTCAATCATAACATCCGTGATAGGAAG
CGGGAATTCGTCTTTCGGACAAGCGGCATTGAGATCGCGGAAATCGATGCATATCCGGACCTTACCATTCTTTTTGGGAACTGGAAC
AATGTTGGCCACCCAGTCTGGGTGCTGCTCTTCCCTAACAAAACCTGAGTCTATAACGTTTTTAACTTCTGACTCAATTGATTCCAT
GATCTCTGGACGAAACCTGCGTTGTTGTTGTTTAACGGGTTTTGCGTCCGGATCAATGTTGAGATGGTGCATGGCAACCTTCGGGTC
AAGGCCGGGCATATCTTCATAGTTCCAAGCGAAGACATCTATATATTCTCGGATGAGAGATATAAGGTCCTCTTTCTCGGATGATGA
CAAGTCTTCAGCTATGAATATGGGCTTAGGATCATGTTCATCTCCCATGTTGACCTGGATCACTTTATCTTCAGTGGGTGGTTCGCG
TTGTTCGAATCGCCATATCCCACAAGATATTGAGACGTTTGATCCAAGGATCATTGGTCGATTCCATCAACTCCTCGTCATCCCCTGC
GTCTTCATCTAGATGACTAGTTGAGACCATGTTCACAGTCAGGTTTTTGAAGAAAGGTCCAATACTGACATCGGACTCGTATGAAGA
TATTCCAGACGAATGGTCGTGACGCAGGTAATTACTGATTTCGTTTTCCGAAGCGGGGGAGGTGTAACGTAACCCATGCCTCTTCC
GGTTTTTTGATAATAGTCCGGAGGTTTTCCTTCAGGAGTGAGAGACATTCGGATCGGCGTTCGCCTTCCTTTCCCGAAGTTAAGGCC
CTGTTCTCATTAAAATTATACCCCATTCGTTTCATTAAGTATATAGAATTGGGTTCATGGTAATGGAATTGGGGAACTCCGTCGTC
TTCCTCTGAACTTGCTCGTTTGAGTTGTTCGGGTTTGACTTTACCAAAACAGATCGGCTTCTGCCCTTTCTTTTTAGATGGGACTTT
GAAGAAAGCCTTCTGTGCGTCCTCCGCTTCTTCATCTGAAGCGAAGGATGACTGAATTGGCAAGGTAAGCGACGCCTCTGTGCACAG
TATGTGCCATGGGTTGGTACCTGCACTAGAATTATTCTCTATTTGTTCATTTTCAGGAGAGACATCAGACAAGTACGCTAAAATGAA
ATCTTTATTAATGCACCACTCGCCCTCACTCGGTACATCATTATTACTCTCACCCTGACCCATTACATCAAAATTTAATTCCCAACG
ACAATCTTCATCGGGATCTGGCTCAATGTCAGCCTCATTACCGCTGTCTACATCTTCTTTCTCTTGGCATTCCGAATAGAAGACGGA
GTCGGTATGGAAGTTTTCCACCCCTCGGAAGGGGTATTTTTCTGCAATCAAGGTTCGGACTTCGCCCTCGTCATTGGCGTACTTCAT
AACCTGATGCAAAGTAGATGGGACAATGCCATTCGCATGTATCCATGGTCGTCCTAGCAAAAGATTGTAGGACGTGTCCGCATCTAT
GATGTAGCACGCTACTTCAGACTTAAGATCTCCGATCTGGCACCTGAGCTTGATCTTTCCCAGGGTCGGGTACTGTTTGCATTGAA
CCCGAAGATAGTAGTCTGGGTGGTGTGCAGTCGGTGCATAGGAATCCCTAAGACCTGCATGACCCTGTAGGGCATGATGCTGAGCGC
TGAGCCTGGGTCAACCTGAACACGACTGATTTCAGAGGATCCAATATACCCTGTGTAGTATAGTGGTCGGTCATGTTCGTGTTTGAC
CTGCATGTCTTCCTGCGTGAATGATATGCATGGTAGACTTCGCGCTGCTTGTAGGCATTGCAGACAAAGTTGATCTTCAAAGGCTTC
GGGAGTCGGAGTTACTTGAGTAATGAAGCTCTCCGTATTCTTCAAAGCTTTAATTAGAGCTTCCTTGGTGGATTTGGATAACCTTAG
GAGCTCATATAGCGTAATTCTGGCCGGTATGTTGGCCAGCTGCGCCATGACGTTGAATTGGAAGGGAGCGCTCGACTCTCCAGATTC
TTGGTGGAGATTTCTGTTGAATCGGAGCTCCTTCTGTTTTCCTTTGTCCACTGGCTTTTTTGGGGCAGAACCCCCAGCGTCTTGGGG
CTGCTCTTCAACTTCTGGAGCATTCTGGCCGTAATCCCTCAAGTAAGTTTTTCCTGACCGAGTGCCAGGGTTGTCTCCTGGGTATGC
TGCCAGGGCGATCCTCTCCTCTTCTGAATCAGTAAGAGGTTTGAGGTGGTCATTATTCTCAGTAATGGAGGGGCTAATCATGTTGGA
AGACTTAGCCTTGCCTCCCTTCTTTTTGGACGAGGTGCTTGTCCATTGTTGATCTCTTAGCAGATCAGGATGGACCCACATGATTTC
CCCTTTTTGGGTAGTGAGAGGCACTAACCCCCTGTCTTTCTGACTATGCGGGTCAACATTCTTCAGGTGCATTTCTCCCTTGCGAAT
GGGGATGACGCCGTTCGCTGTTACCACTGGGGGAAAGTCACCGAATTGGACCGCTATCATATTACTTGATACGGTCTTCTACTCTGG
CTTCAAGGTGAGTACATTAGCATTCACCAAATTCTGCAAGATGTCTTTGAAGACATAGCACTTTTTGGTAGGATGTCCAAGGAATCT
GTGATAACGACAATAGTTGGGGTCATCCACTTTCCCTGCTTCATCCGGCTTTCTGATCTCAGGTAATTGCAGCTTGTTGTTCTTTCG
AAGCAATTGGAATAAGGTATCCACATGCTCCTCTTTGAACGAATACTGCTTGGGCGCTCTTTGCTGATTTGGCGCCTTGCCTTGTTT
ATTCGGCGGTGGTACTCGCGTGTAGTCGGCTGCCAAAGTCTCCTTTCCCTTAGACCACTGGGCATTTTGCTGATTGCGTTGCTGCTG
CGGCTTGGGTTGTGGCACTTCTTCAACTTTGACTCGCGCCACTATCTCTTCAGCTTGTTCTCCTTGTGAAACTAGTTGTCTCCAGGA
GCGACATTCTGCCACCCCCATTTGAGCAAGGAGCTGGGTCTGCAGGTTGTGCCTGCAAGTTTCAACCAGAGTTGATTGGGTCATACC
TGAGGGGCATCGTAATGCCATGCTGCGGAATCTCTCCACATAGGCCTTGATGGACTCTCCTTTCCTTTGCTTAGTGGCCAGAAGAGT
TGGGACTGAGACCTCCGTATCATCCTCAAAGAACCTGGCCAAGAATAGCCTTTCCAGGTCTACCCATTTCTGGATAGATCCAGCGGG
CAGTTTCATGAACCATTCGAAAGCAACACCTTTAAGAGTGCCGATAAACAAGCGCGTCAGGATGGCATCATTTGCTACCACATCCCC
TGTTTGGGACTTGAAGTAGTAGATGTGCTGATTTGGCGATCCTGTGCCATCAAACGGTTGTAAGGTAGGGGCCTTAAATTTCGGTGG
GTAGGGAGCTGTATCCCACTCAGCAGGGTAAGGCCGCACTACTCCCTCTTCGCGGAGCTCGCTTCGGTTGGCGATTGCATTGAGGCG
AGCTTCCAGTTCATCCACCTTGGTAGATTGAGGGTGCAGTTCTTTCTCCATCTCTCTCTCACCTTCGGAAGAGGATCCTAGGTGGTG
AGTCTCACGATCCGAATGTTCGGTCGCTTTTTGTTTTCCCTTTGAAGTAGTCCTCCGGGAAGATTCAGGTTTTTGGCCTTTTTCGGC
AAGGAGCTGGGCCAACATATCCTTTAACTGGAGAAGTGTCTCCTGCTGTGCCTGGAGCATGACATGATGTTCGTCCACTCTTTTGGT
TATGTCTTCATGGTTCCCTGTCGTGTAAGCGGAGACTTCCCGTGCTCCGACAGAGCTTGAAGATTGAGATTCGGCTATTGCCGAATG
TTCATCACTTGTTGTAATCCCCTTGGCTAACTTTTGATAGTTAACCGGACGAATAGCTCCTGTCTGAGTCCGAGTATTCTGATATAC
ACCTTCGAACTGGTCACAAATTTCTCGGACAGTCGGGGGATGACTCTCTTGCGACTCATCGGAGTCAGTATGCGAAGCTTTCCCTTG
GCCGATCATATTGATAGTGACCTGAGGGTATTCCGCTTCAGCTGTCTTCTTTCTGCAGCGGCGTTGTCGTTTGGCAGGCCTAACGAC

Fig. 13L

GTTCGTTAACCTGTCGAATACGGACTGTCGTCGTGTGGGTGCACAACAAGGCCATTCTGACAGGACTGCTGAAATCAGTCTCTCACA
TTGACATGAGTGAGCTGCTTGTATTGTTGGTTTTCCTCTTGACAACAATTCCCGTAGGTCGGAAACTTGGGAGGAAACTTTCCCTGG
GCTTGGAGGCGGAGATTGAACCCCCTGCCCTTGGGTAGGTGAAATTGGTTCTCGTTGAACGTGGATTTTGAAGCCACGCTGATTCTT
CTGAACCTGGCGGACCTCTTGGAGATCGCGTTCTTGAAGGATAACGCGAGGGTCGCGCTTAGCTTTGAAAACATTAGGCCGAGGCCT
ACGTTTAAATGATGAAACTGACCCATGAGGGTCATGTTTAGGTTGAACGCGCCCCTGAGGGTCGCGTTTAGGTTGAACGCTCCCCTG
AGGGTCGCGTTTAGGTTGAACGTTCCCCTGAGGGTCGCGTTTAGGTTGAACGCTCCCCTAAGGGTCGCGTTTAGGTTGAACGCTCCC
CTGAGGGTCGTGTTTATGTTGGACGCTCCCCTGAGGGTCGTGTTTAATTGATGAAACAGACTCCCGAGAGTCATGATTTATTGGAAC
GCGCCCCTGGGGGTCGCGTTTGGTTTTGGCAGCCCTCCTCTGAGGGCTGCGTTTTGAAGAAACAACGCGCTATTCAGGGTCGCATTT
CAGCTGTATGAGGCCAGGTTCATAGTTGGGCTCGTTGCCGCGAAGTGAGCGTTCTCCTTTGGGAACGCTAGGCTCTGTTGGATTTTC
AGAAACGCGATCTTCGCGTTGGGCCAACAGTCAGCTTTCACGTAGATGTGCTCGTCGTATGGATCTTCTCCGTCGGCGAGCGGCGTT
CTTCTTGGCTTGTTTCAAAGCCTTAGCAGCAGCATCGTTGACGCTTATGGAACTCGTTTCCTCCAGAGGCCGTTTGTGGCCTGAAGA
ACGTCTTGCTGACGCGGATGTGGGATCTTCCGCCAGCAGAGCCAGTTTGAGTTCTTGGCCGAAGGAGAGGGCTTTCTTCGGCACTTC
GACAACAGAATTGACCTTCTTGGAGGTCTCGCGGACATCCTGCTTAGCCTTGGGGCTAAGCGATCCTGAGGATAAGGCTTCCTCGTA
CTTAGCTTGATCAAACTCTACGACGAGAGTTCCCAACTGCCTAACGTCAGCCACATGGTCTAGGAGAGATTGTCTCAAATTCGCATA
AGTCCCCCAACCAAGGCCGACGATGGAGATCACTTACTTTGCAATGTTCTCCAATTCATTAAGGTGAGCCTGTAGGGAGAGGGAGCC
TAAAGAAGTAGGCTCCTGACCGCGGGCAAGTGTTGTGAAAAGCGGGATCTTGGGGAAAACCCTGTTTCTGGCTGAGGAGAAGACTGC
AAATCGGATGCGGTCACAGCTTCCTCTAGTTCGTCATCAGAGATGAGGATTGGTTTAGGTTCAGGCTCCCCAACAGCTGGCGCCCCC
TCTCGGGTTGCATAACAAAACAAAGAAATTAAAATCGTGGACTCATCTCGCTCACACGGCCTTTAACCTGCCATGAGGGTTAGAGAT
AGAAGTCGACTTATAACAGGCATGAGTCGACTCAACCTGATGGGTCGACTTATGATGTTGTGAGTCGACTCGTTAGAAACAAAATGT
AAACTACACGACAGTTTATTAGTCGACTCAACACTGTTCATGAGTCGACTCAAGACATGCACACAGTCTGTTTTAAACAGAAATCTA
ATTTTCAAACATCTTTTAAAAATAGCAAATAAAATCAAAAAAAATGTAAAACTTTGGGAAATGATTGTAAACATAATAATAAACATG
TTACAAAAATTTGTTTTTAAAAAGGACCTCTCAAATGAAAAATATCATCATTTTTCAAAATAGTCCAAAACATAAAAGTGTAAACAC
ATGAGTTTTGATATTTTAGCTTAACCATGTTTTGAAACATTATAAAATGATTTTTTAGACTTAATAAAAGATGTATATGTTTATTGT
TAAGTCTAAAAACTGAGAATACAAAATTTTTATAAAATTGCATATTTTGCAAACTTTTCAAAAACAATAAATATGATTTCATTAAAC
TAAATAAAATTGATATTGATGAAATCATATATATGCATATAAGTATGAAATAATAAATGTATTTTCAATTGTATTCAATTGTTTCAT
ATTAAAACTTGAAAACTATTAAACCAAAATATATATGTATATATATAACTATATATATACAAGAAACCATAGTTAAAGTGTGNATAT
ACAAAGAAACCAATAAAATGTGTGTGTATATATGATTGAGCTTAAAATACTTAACACACATAATATAAACTCCTAAACTAGATTACC
CAAGCTATAGGTCTTCAATAAGCTTGACTTGGTACACTTACGGATGAAGCTTGAACTTGAATCTTTAACTTGAATTGCGTAGCTTCA
TCCCACGATTCCGCCAACCTCCATTGGATATGATCGTGAAAGCTTGATTCCATTCATCCTCCAACATGATGTTTGTTTATAATAAAT
AGATAAACACAAACACTAGACAAACAATATTAGTGGTAGATTATTTGTTAAACATCATCAAAACAAAGAGGCCAATAAGCATACCAT
CTGCTAGATGGTAGAATGACCTCTAGCCCCTCTGAAAACCCTCCAGAAGAAGACACACCATAAGGGTGGTTGTCTTTCTTGAAAAGC
AACATTGGCTTCTAATCGCCATCACAGAATAACTTTAGCCAAAACATAGAATTTGATCAGGCCAAATATTACTTAAGCTCTAACTGT
CAATAGCTCATATGAGCATAGGAGCAGTGATTAAGTCTGTGATAGGCGCCTTGGACCATGAGGACTTTTTGAAAGGAACTCTTATAC
ATCAGGGATGAGATTGTGGGAAAAACTTAGGGCCTGTCAGCTGATTGTCTTCTCAAGAAGAATGACATTGGTTCTTCAATTGACGCC
TGCACCACTAAATTTACCTAAGCTCTGGTGGTCAAAGCATGTGACCCGTATGATCCTCATGATCCCCATAAGGGAGAGTTCTCTATT
TACATCATGCTCCAGTCCCCGGTACTCCTAAAGCTCATTCGAGGAAACCGATATGGTTTGTCATTTTCAGGGAGTACAATATCGGCT
GGTGGATTCTCTCTCCAAGAGAATTTCTACCACAAAAGGTACCATATAGCTTCCGATCGTGCCCCCAACCCTCGTGAACCAGACTTA
GAAAACATCATTCAACATGATTCGTGGTGTCTGGGTAGTTCCTTTTGCTAAAATCCGGCATACTAACCATCCGCCTTCAAGGCCGTA
CTGAAGATTCAGACTCAAAGGAACCTTGGCTAATGAGATGGCAAATGGAGTTTCGACTCATCTTCATCTATCATTGAGCAGTCCGC
TATAAAAAAGAAAAAAAAGCAAGCAAAATCCAACTAGAGAGGTTCTATATTGGCAGCCTCATCCATTACAACACTGCCTTTGTGAAA
AAAAAGACAAAGCAAGACCACAAGTGGTTCAACCCCCTTTTTGGGCACCAGATACCTACAAAAGATATTTTTCATGATCATGTAAAT
TTTAGAATTGGTGAAATCTTATTGAATATGAATTAACTCATATTTCGTAGGGATTAAGGCTTCATTATGGCTAAAGACCTAAGCACT
CCCAACAAGCCCTTGGTACCTTATCAGGAATAAACCCAAGGCACAACCCTTTGGCCGACTCCCATAGTCGTCTCACAGCCTTAGGGG
AAAGAAAGACCTAGTCGACTCTCTCGAGCCTAGGCGTTCAACTTCGGAGTCGGATTACAAGCTCTTGGTACCTTATTAGGAATAAAC
CCAAGACATAACCCTTTGGCCGACTCCCATAGTCATCTCTCGGTCTTAGGGGAATGAAAGACCTAGTCGACTCTCTCGAGCCTAGGC
ATTCGATTTCTGAGTTGGATTACAAGCCCTTGGTATCTTATCAGGATTAAACCCAAGGCACAACCCTTTTGCTGACTCCCACGGTCG
TCTCTCAGCCTTAGGGGAAGGAAAGACCTAGTCGACTCTCTCGAGCCTAGGCGTTCGACTTCCGAGTTGTATTTTCATGTCCTTGGT
ACCTTATCAGGAATAAACCCAAGGCACAACCCTACGATCGAATCCCACAGTCAGCATTCGACAATACTAGGATTATGAAGACTTAGG
CACCTACGTAAGACCTAGGCACCCAACCTCAGGGTTGTCATTCTGCCAAAAAAAGTATTCATAAGCCTAAGGTATGAATATTAAGTG
TATGGCCAATACTTAATTGATCTAAAAACTTAAGCACTCATCTGTCAAGTTCTGGTCAATTAAACACTCAGCCAAACTAAGGCATCA
GATGAACTAGTTGTCATAAGTCCCCAGTATGGGTCGACACATTACAACTAACTCGCTTCAGCCAATATTTCAAACAAAAACAAAGTT
ACAAAGCTAAAAGAATATAAATAATGAAGGCAAGCTCAAGAATGGAGACAAAAGTTAATTTTCATTCAATAAGAGTAAACTTCATTA
CAAACTTCTCTACAATAAAAAAATTGAAGAGATACGGGTCTTCAAAGCTCTCGACCAGATTTGGGAGTTAGACTTGGCGGTATTCGG
GTGGTGGCAGTTGCAGAAGATTCCCTAGGAGCCCCAGCAATAGGTTCGACCTCATCATCACTCGTTGATAAATCCAACCCGCCTCCA
TTTTTCTCGACATCTTTTAACAAATCGAGATAGCAGGAAACACGGGGAGGATAGAAGCAATCTGAAGTAGGATGAGAGTTGCCAGGC
ACTAAAGAAGCAAAGTAATCGACTCCGGCCTTACATGCTAGGGCCATCTCGGCTTTCCATATAGAACCATGATGTCAGTTGTCGACC
ACCTTCTTTTTATGCTGCTCTGAATCTAGATAAATGATTTTTTTTCTCTAGTTTCTGGACGAGGGCTGTGGACGCCCGAAGCTTTGA
TTGTATCTCTTCAAAGTCCCTTCTCATCTTCTCGAGAGATAGGCGACTTGATTGAGCCTCTGTCTCAGCTGTCATCCTACGACTATC
TCAGACTCAACCTCTGCCTGTAGATGAACCATCTCTCTTTGAAGGTTCTTGATGGTCTCCACCAACTTGGAGAACTGCATTCGAAAG
CTCTTAAGGAGCTCTTCCTTCTCATCCAGACTCCGGCACCAAACGCCTTCTTTGTGAGCTAACTCGGTCTCCAAGATAGTGATCCTC

Fig. 13M

TTCGTTGCCTCTTCCTTGGGCGACTTCTCCTTAGCCAAGCCTACTTGACATTCCAAGGAACGCTCAAGTCGATTAAATAAGGTGCAC
TCCAGCAAAGTCCCCCAAGCCAAACAAACCTCGAGAGCTTGGTGTATGCCAACACTTAGCATATCCTCCAAAATCCTCCCCTCAGTA
CCATTGTCCATCTGGTCTGACGGAGTTTCAGCTCTCCTCTCAACACTATTGTCCATCCCAATCAGCTCCTTTTTAGGACGACGAGAC
GCCTTAGGAATAGTACTAGGGCCGACGACATCCTCCTCGACCGCTAAGGCTGTTATCTCCCTGTCAGGAGAAGACTCATCTATCCAC
CCCATATTCTCCAAGCGGTTAAGCTAATTTACCAGTGAACCGATCCCAGTTGGTTGGAGCTTCCCAATCGGTCCGATTGGGCGCCAT
CTCTCGACATTTGTCCTCCTCCTTAATTCAAAGACAATTTTAGTGGCTTGAGGCATCAAGACAGCCACCTCCTCAGCACTGAAGCCC
TCCCTCAGCTTTTTATGGTGCCTAGAAGTGGAACTCAACTCCTCGGTCCCTGCATTCCTCTTGTGACTTTCTGCCAACAGAGGAACG
GGGCTCGTCCTTGCTTGGAAGCCAGTGGAAGACAAAATCATAGATATGCCCACCGTTTGGAGAGACACATCATCAAATAGATCATCG
CTCTCTCATGGTACAGCATAAAAAACAGACCTTGTCCAGAACCATTATCTCGGAATCACTAAGGGTGACTAGCCTCAACGCGTCTTC
ATTCGCCTCCGGCCAGCCCGAGCAGGCGAAGACATTGTCGCCACCATAGACCCACACAAATTGCTCCTCTAGTCCTCATCCAACTCC
AAAGAATTTGAGACAAGCTGGAATTCACCATGATAGTGAAAGGAGTAATGCGGGTCCTTCTCAGCTGACCCCACGCCGATCAAATGC
CCAAGCAATCTCAAGCTTGGTTGGACTCCAACACGATGGCAAATGATGATGAAAGCCACCAGAATCCCCACTGTGTTTGGATAGAAC
TGGAAAGGGGAGACTCCTAGAGCAGTGTGCACCTCCTTAATAAAAGGGTGCAAGGGCAGCCGTAAGCCATGCTCCAAGTGGGCTAGG
TATAGCGGCACTTGATCCTCGCCATGGCAATATACTGGCTCGCTTATCTCTGGCGCCACCAATGTAAGAGTTTGAGAGATATTGTAT
TGATCATACAACCCCAACAGATTATCCATATGGACCTTCGAGCTGATAAGTAGAAGAACAGCGAGTCTCTCCTCACTACGGCCAGAG
TTTGAAACTTGAGAGGCCATGGAAGACTTTTTCTTAAAAAATCTTGGAGGAATATTAGGAATTTGTCAAAGCAAAGGTTCCTAAAAG
AATTATCTTGACATTAAGAGGCTATTTATAAGCTTTCAAGGAAGACTATAGAGGAATTTCAAAGGATGCGGTGATTTTCGAGGCAAC
CAGGCCCGATCCACTTCGGAATCTGAAGCGGTTCACTCAAAACATGAAACGTCACCCTCATTTAATGCCCCACGTCCCATTACAATA
AAAGCGAAAGATGCTCCATTATGTCCGCGACACTTCATCTCCTAAAAAGAAGGTTCAGATCTTTGATAACATCAGCTCTGAAAGCA
GAGTCAACAATGGATGCTCGATAAAGACTTCTCATTTTTTCGTCCTCAGCAGGCTTGTATTGATCAGAACATATCTTATTTCTCTCA
GAGCTGACTAAAAGTCGACTCCAAGTGAAAGGGGCAACTGTTATGGTGTTCACTCACCCAAGATATGGGCATTTACAAAATGATATA
ATAAGAGTCCTAACAAAATAACCTCAAACCCACTTGAGTGGCCCAAGCCCAACGGAGGCCTCGACCTCGCCAACTCATCAAGTCGAC
CTTATTTTATGCCAACATGAAAGGTGGGATTAGTCGACCCTATCACCGAGGGCGACCCACTTAGAGCACTCGACCACTCACTGGGTA
ATTCTCGGAGATGACTTGAGGGACATTCCCTACTGTCGACTAAGTTAAAGACTCGGCCCAAGCCTAAAGCCTCTCCCCAGAGCATAT
GTTAATATTTCAATCCATGTCAGACAAACCTTATCCAGATTTTAGCCTAATGATCTATGTGACTTGTCAGCTGCCCAAGTGCCGAAG
TGACTTCTCCTCTAGTCGCCAGTCGACACCTATAAAGCGAGGGACGATTCAAGTATGCACACGTGCCTTCTGCCGCACCATCAATCA
CTTCCCGAAAAATGTGGAGACACCCTCTCCTGTGCCGAACTGACTTCCCCTCCAGTCGTCAGTCAACACCTGTAAAGCGAGAGATGA
CTCACCTTCCAGCTCACACTTTGCCACCATTATTTCATGACTGAATTGACCAATCTACCCTTAACATCCTATTTATATACAGATGC
TATTCACCATAGCTGGAGAGAGGAGGTTCATAACCTAAAACCCCCCAAAAGCATACATGGCAGAAAAAACAAGAACACACACTTCTTT
GTCTAGACAAAGGAGCTCATGTAGATCCTCTGGCAGAGACATTGCCACTTTAAGAACCATATTGGTTCCTGACCTTCCCTTTTCCCA
CTCAAGTTTCACTAACTTTACCGTCGAAGGAACCATGGGGGAACCGGTCCCTGCCCTCTTACGACTCTTTTGTGTGCAGATTGCTCG
GCCATCCTAATTCTAAAACTAGGCATAAAGTCGAAGAAGAAAGCGGCCTCCTTTTTTTTATAAACTATGAAAATCAATCCCCTGTTC
AAGAACTAGGAATAAAGTCGAAGAAGGTAGTGGCCCCTCCATTACTCTCCCTTACCACGTCCCGGTGAGGACTCAAAGGAGACCGAT
CCAGTTCCGGACCAGAATCAATCCCAGCCTAGATCTAATTGGATGTGTGATATTTAACATCAACAATAACTATTCTCTAAACTCTTT
CTCTATTTATTACCTTTGCATTTAATTTGATTGGTGTGTTGCATTGGCAAATTTTAATTGCACATTTATTTTCACATTACCCTATTC
ACCCCCCTCTAAGATAATTTCACTTGTCACCATAAGGCTCAACCTTCACCAGCATGTGACTTACAACATCTCGCATGGGACCACCAC
TAAGGAGTTGATGAAGGCCTTGGAGGCATTGTATGAGAAGTTGTCTGCCTCAAATAAGGTGTACCTAATGAAGAAGCTATTCAATCT
AAAGATGCAGCAAGCAGCTCGCGTAGCGGACTTCTTAAACGAATTTTAGGCTGTGGTGCAACAGCTTGCTGCAATGGATCTCAAGTT
TAACAATAAGATCCAAGCTCTTCTGCTACTTTCTTGTCTACCAAATTCATGGGAGAATATGGTGATGGCGGTGAGCAATGCCAATGG
CAATGACAAGATGAAGCTCGACACGGTGATTGGGGCAATTCTAGATGAAGAATCTCGCCGCAAAGTCTTAGGAGTTGAGACCTCTAG
CATTGGGAGTGCTCTGCATGTCGAGGCAAGAGGGCGTGCACAGAAGAAGGGTAGGGATGACGAGGCTGGTCAAAGTCCAGAGGAAA
GTTTAAAGGGTCGGACCCGAATGGTTACCGTGAAGGAAAGTGCTTTATATGTGGAAAGAAGGGTCACTTTGTAGGGGACTACAGACC
TTTGTTCTAGCATCAGAAAGGGATGATCAGGCTGACGGTGCAGCCAATTTTATGCACGAGACAAATTTGGATGCACTTCTTCTATC
TCTTGAAGATAAGAACGATGTGTGGGTCATCAACTCTGGCGCATCTTTCCATGCAACCTCACAACAAAAGCTGCTTTCATCGTTCAT
GAAGAAGGACTTGGGGATAGTCTATCTTGGTGATGATCAACCTTGCAAGGTCTCCAGAAAGGAAAATTGTACCCTCAAGATGGAGGG
CGGGACCACCTTGACGCTGAACAACGTTCAGCGTGTACCAAATCTCAGGTAGAATCTTATATCAGTCGGGAAACTGACTAACTCTGG
TTTCAGATTATCCTTCAAGCAGGGAAGCTGGAAGGTGTCCAAGGGTGCCCTGGTGGTAGCATACGGCAAACGCGAGGGGTCTCTCTA
CATCACCAATGGGAAGATCAGCCGCTTGCTTGCTGCAGGACAAGCATCATCATCATCCGCCGACTACATGACTTTGTAGGTCCTAAA
AAAAATGATTGATTGATTCCTTCAACTGTATTAGCTTTGGAGAAAATACTCTATTGGTTAGTAAGAGTCTCCTTACAATCACTCTTT
AGTCGATTATAGAACAGGAGAAGATTGGTTCGACTTCTCCTTTGTTTAATATGGATTCTGGGTGGCGAAAGGATGCCTCACTCGATG
CTTGAGTCGAGCTTGCTTCCCATTGATTATCAGAACAAGAATGCATGGTCAAGTACTTGAGCCGCTGTCGGTAGCTACTACTGATTC
TTAACCACAAGAACCTAGGTTTGGATCTTCAAGCTCGAGTGCAAGAGCTCTGCCAAGCCATGGCCAGAAAAAAAAAGTATGTCCTTC
ATAATTGATCATGGCTACTTATAGGCCTTAGCTCGTAACTGATGCGCTGAAATCGTGGAGTCATGGCATAACTGACTCCCTAAATTT
AGCCCACATGGGCTGACTAGGTCAACAAGACCGTTATAGTCTAGCTTCATACGGTATGACGTGCCTCACTGCATTGTGAGGTTCCTC
TGATAAGACAAGCCTTGATACGCAGCGAGGTTCGTCTAACAGAGTGAACTTTGCTATGAGATGAACTTTGTCTTTTGAAATAGCTTT
GTCTTCACTGACGAGCTTCATCCTTAATGGTTGAGTCCAATTGCGTGATGAGCCTTGTGGACTTCTTCTGATGAACTTCGTCTTCAC
TGACGAGCTTCGTCTTCACTGACGAGCTTCGTCTTCAATAATGAGTTTTATCTTCACTGACGAGCTTGAGTTTTTTCTTCATTAACG
AGCTTCGGACTTTGTCTCCAATGACAAGCTTCATTGTTTAAGACGAGGTTTGTCATAGTAATGACCCTCGTCATGCTTGTGGTGAGC
TTTGATGCTCCTTTGATTTTTGGTAGTTTTTTAGTGCCTACAAGACCTCCTTCAAAGTTTTCAGACCTGAATTAGGTTGCATGGGGT
CTGAAATACTTTGAACCCCTTCTGATTACCATGAGTTTGGTTCGTATGATGAACTTGCTCTCTTGGTTAGCTTCAACGCTTCAGAAT

Fig. 13N

GAACCTTGCGATTCGCCATTTCTAGGTGAGCTTGGACGCTTCGAAACGAGGCTCGACATTCTGTTGAATCTCACCACTCCATATGAG
CTTTGTCAGGCCCATGTTGGTCTGACAATTCATTTTGTCAGCATTAAATGCAATGGTCTCCATCATCGCACCTTTTCTAGGCCTGAT
AGGTGGTCGCCAGCTAGCACTCTGAAATTTGTTCTGCGGATTTCGTCTACAAATCTTGTCTGTTACAGATTTCATCTACAGATCTTG
GCCGTAGATCTCGGCCACTGATTTGATTTTTTTTCTACCTATAAATAAGCGTCCGCCTTTGACGAAATTTTTTTCGTCTTCTTCAAA
CATTTGAACCCTAGGTGCTTCGTCTGCATAGATTCTTTGCCTTTGATTTTTTCACAAGACTTCGCACTGATGGCCCCAAAAATCACC
GCTGGCAAAAGCAAAGGCAAAAGGGCCTCTAGCTCCCATCGCTTTGCCTATTTTCTCAGGTATTGCAATCGAACGCAAGTTTTACAT
TTTAGAACTATCAAACTCTGCCTATTTCAGGCTTGAGTCTTCGAGGAAGATGAACAGTTTCCTTTTTTTTGAGACAAAGCTTGTTTG
ACGGATGAGATTTGTTTGTTAGGCGAGGCTTGTCGATCTGATGAGTCTCGTCTTTTCTAACGAGGCTTGTCTGTTGGATGATGTTCG
TCTGTCAAACGAAGTTGGTCTGTCTAGCAACATTCATCTATTTAACGAGGTTCGTCTTGATGGATGAGGTTCATCTGTCAAACAAAG
TTCGCCAGTCTGATGAGGCTTGTGCCATTCTTTGGGTGAATTTTTTTAGCCAATGTCCCACCTATCTTACTTGTTTGGGCTAACCTT
ATTGATTTGTCCTTTGCAGTTTTGCATTCTCTTACTCCGATTCCTCCACGTGGTGACATCGGGTCGGATAATACTCAGACAAGAACG
GACCATTCTCATTATCCCATGTTTGAGAATCTTCTCGTATTCCAAAACCGAAGTCAAGAAGAATTTCACTTACTCTCTGAGCCCTCA
AGTGTCACACTAAGGCATTTGATCATAGACGCTTCTTTAAAAACAGCTGACCAAAGCCACATGTCAAAACCTATTTGTTGGATAGCA
GGGTCCTAATCTATTTTGGTAACAGGTTATTAGGATTCCTAATCTATTTTGGTAACATGAGGTTATTAGGATTCCTAATCTTTTTTG
GTAATATGATTCTTAATCTGTTTTGGTAATAGGTTATTAGGATTCCTAATTTGTTTTGTTTTTGGTTTTAGGATTCTTAGTCTGTTT
TGGTTTTAGGTTTTCTATATATATGGAACGCCTTAGAAGAGATTAGGATCAATCAAAAAGAGGAGAGTTGTAATCAGAGATTAGAGA
GACTTTTGAGCATTGTGAGAGGGAGATATTGTGAGCAAGTTGAGAGCTTTGGTTGAGGTTAGTTTGTGAGTTTTGTGAGATTGTAA
CCCTTTGTACTCTGTTTGATTTAGTGGAATCTCCCCATCCTCTCCCCGTGGACGTAGGCAAATTGCCGAACCACGTATATCTCTGTG
TTTGGTTTGATTTGTTTGTATTTGGATTGTGCTCGTGTGTGATTGGTTATTCTTCTCTCATGCTTACGACTTGTTTGGTGAGCGAGCA
CGCTTCTGTNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNTCATCGG
TCGACCGGCACGGTCGATCGATTTGAAAATCGAGATTTCGGTCGACCGTACCGGTCGACCGACGACCTCTCTGGAAAATACTGAGGA
AAGGCGATGGGAGCGGTCGACCGGACCGGTCGACCGCTTTCTGACATTTTGCAGAAAACAGTTTTTGACCAACTTTAAATATTTGCA
AAATATTTATTTGACCTCTGAAAAATCTGAAACTTTGTAAAATGTTTTTAATACTAAAAACAAACTGTTTGGAAAAAGAATTTTGTA
GATAGGTCCTCATACTTGTGAAAAATAGTATTTTGTGAAAAACGCTTAAAATTATAAGTATGAAATCGTGTGTGTGATTCCCAATAG
CTTCAAGTAAACTTAGTAACTCTTTGCCTACATTCTAGCACTAGAGAGGGAAACAAAAGAAAGCTAATATCCTCATATAGAGAGCAA
TACTTGAGCTTTGATATAGCTTGAATCGGATAAAGCTTTTAGTCGAATTTGACGTTCTTGAAATAACGTTGCTTCATCTCTTGGCCT
CCTCCTCCTTTGGATATCTTCGTTGTAGCGTATATTCCATCCATCCTCCGTTAATGGCACTAACGAGCTTGATAAATGAATTTGCTA
CATTTTCACTCAATAAGCTATTAGTACCGATAATGGTGGTTGTAAAACATCATCAAAACATAAGGGCTAACAATCTTCCCCTTTTTT
ATGATGACAACCAACCATTATATAAGAGCAAAAATAAAATAGCTTATAGATAGGTGCTCCCCCTATCTATGAGCTCCCCCTAAATAT
ATGCAACAAATGAGGAGATTTCTCTCCCCCTTTGTCACCATCAAAAATGGGGAAAGAAATGCAAAATGCAAGATGCAACTAAACAAG
CAAGCAATGTAGAACTTTCACATAGTGCATAAGCCCAAACCATTTCTTATGCGACAAAAATCATCCTCTCCAAGAGGCTTAGTAAAT
ATATCCGCTAGTTGAGATTTGTGTCAACAAACACTAGGGATACATCTTGTCGCTCTACATGATCGCGTAAGAAATGATGGCGTACA
TCAATATGTTTAGTTCTAGAATGCAAAACCGAATTTTTGGAAATATTTATAGCACTTGTGTTATCACAAAAGATTTTAATATTTTGA
AAATTCAAATCATAGTCAACTAAACTTTGTTTCATCCATAAAACTTGAGCACAACATAAGCCGGCGGCAATGTATTCCGCTTCCGTA
GTGGACAATGCAACACAATTTTGTTTCTTGGAAGCCCAAGAAACAAGGGAATTTCCTAAGAATTGGCATGTTCCACTAGTACTCTTG
CGATCTACCTTACATCCGGCAAAGTCGGCATCACAAAAACCATATAAATCAAAAGAAGTGCTTCTTGGATAAAATAAACCAAGGTTA
AAAGTTCCATTAACATACTTAATGATTCTTTTAACCGCAATTAAATGAGATGCTTTTGGAGATGCTTGAAAACGTGCACATGCACAC

Fig. 13O

ACACTAAACATGATGTCGGGTCTACTAGCGGTGAGATAAAGAAGACTACCTATCATACCTCGATATAGTTTTTGGTCTACATCTTCA
CCACTCTCATCCGCATCAAGCTTAACACTAGTACTCATGGGACTAGGCGCATGCTTAGAATTCTCCAACTTGAATTTCTTCACCAAT
TCCTTCGCATACTTGCTTTGTGAAATGAAGATCCCATCCTTAGTTTGCTTGACTTGGAGCCCGAGAAAGAATGTAAGCTCTCCCATC
ATACTCATCTCAAAGTGATCCTGCATTACTTTAGAGAATTCCTTGCACAAGGATTCATTAGTAGCACCGAAAATAATGTCATCCACA
TATATTTGAACTAAAATGAAATCATTTTTCCTTTTTCTCACAAAAAGTGTGTTATCAATTGTTCCTTTTGAAAAATCATTTTCAATA
AGAAAACTAGAGAGGCGAGCATACCAAGCTCTAGGAGCTTGTTTCAACCCATATAAAGCTTTTTGTACCCGGTAAACATGATTAGGA
AAACCATGATCTATAAAACCGGCGGTTGCTCAACATACACTTCCTCTTCTATAAAGCCATTTAAGAAGGCACTTTTAACATCCATT
TGAAAAAGTTTGAAATTTTAAAAGCTAGCAAATCCCAAAAACATCCTAATAGATTCTAACCTTGCAACCGGTGCAAAGGTTTCATCA
TAGTCTATGCCCTCCTCTTGATTGTATCCTTGGGCAACCAAACGAGCTTTATTTCTAGTAACAATGTCATGTTCATCAAGTTTGTTT
CTAAAAACCCATTTTGTACCAATTACACTAGCATTGTTAGGTCTAGGAACTAACTTCCAAACTTCATTTCTTTGAAAATTATTTAGT
TCTTCATGCATAGCCAAAACCCAAAACTCATCATTTAAAGCATCATTAATCTTTTTAGGTTCTAGTTGAGATAGAAATGCAACATTA
CCACATTCACTCAAGGCTTTTGAGCGAGTTATAACTCCTTTTGAAGGGCTCCCAATGATTTGTTCCTTTGGATGGTTTGATGTGAAT
TTCCAAGCTTTAGGTGGTTCAACTTGTTCTTGAGCATTGGTGCTATCTACATCCTTTTGAACTTCTATAGAGGGAGTGTCATTGATT
TGCAACAAGTCCAATCCTCCCTCAATATCATCATCATCATCTTTCCTAGGCAACACAACTTGAGAGCCAACATTAGTCTCATCAAAA
GTAACGTTTATAGACTCTTCAACAACGAGCCTTCGTTTATTAAAGACCCTATAAGCCTTACTTCGAGGTGCATAACCCAAGAAAATA
CCAACATCAATTTTGGAATCAAATTTATCATGGTGATCTTTTGTATTTAAAATAAAGCATTTGCAACCAAAGACACGAAAATAACCA
ATGAAAGGAGTTTTTCCATAATAGAGTTCATAAGGAGTTTTCTTAAGCTTTGGTCTAATCAAAACACGATTTAAAACATGGCAAGCC
GTATTGACGGCTTCCGCCCAAAAATATTTTGGTAAATCAAATGAGTTTAACATAGTGCGTGCCATCTCTTGTATGGTCGATTTTTC
CGTTCAACAACACCATTTTGTTGTGGTGTTCTAGGAGCGGAAAACATATGAGTTATACCATGATGAGCACAAAAATCATAGAAAAAT
TCATTTTGAAATTCACCACCATGATCACTTCTTATTTTAACAACTTTCAAATCCTTTTCATTTTTAATTCTTTTAACATGATTAGCA
AATTCTTCAAAACAATCATTTTTCTTTGCAAGAAATATTATCCATGTAAAACGAGAAAAATCATCAATAATCACAAAAACATAGTGT
TTGCCTCCAAGAGAGGTAACACGCATAGGACCAAATAAATCAAGATGAAGTAATTGCAAGGGTTTAGAAGTCGATACCTCATGGATG
GATTTAAAAGAAGACTTTGTTTGTTTACCTTTGGCACAATCCTCACAAATTGTATCTTTTATGAAGTGCAAGCTAGGTAGCCCTTTC
ACAAGATTCTTCTTAGACAATTTTGATATTAACTCCATATTTGCATGCCGCAAGACACTTCACATCTTGATTCACTAACTCATTCAT
CTTAAAAATGTAAACATTAGACTTGCGATTTGCAATAAAAATAATTTTTCCATCCATACTAATGATGCATTTATCCGGTTTAAAAGA
AATATCAAAACCTTTATCACTTAATTGGCTAATGCTAAGAAGATTATGATTCAAGCCATTTACTAAATAAACATCTTCAATAATGGG
TGAGGGTTTCTTAACAATAGAACCGATACCAATAATTTTACCTTTCTCACCACCACCGAAGGAGACATTGCCTCCTTCAATCCTTGA
TAGGTTTGCAAATAACTCTTTGTTGCCCGTCATATGATGTGAGCAACCACTATCAAGGTACCACATCTCCTTACGTCGTTGCTGTGA
CGTTCCTTACAAAAGAAGAAGATGAAGGTGTAGTAGCTTTAGGTACCCATGTCTTGGGTCCTTGGTGGTTAGTAGTCTTGGTACCTT
TGGGTACCCATATCAATCCATAAAAATCATGGTTATCTTTAATTCTACAATGAGTAGAAATGTGTCCATGTCTCATACAATAGGTGC
ATACAAAATTTCTTTTGTATGTACGAATGTTAGAACCACGAAACCTATTTCTACCATGATGATTGTAGTTGGCATAAGCGTGAGTGG
GTCTAGTCCTAAAACCCTCAATTTCTAGTCTTTTAATCTTTGATCTTAATTGCTTGTTCTCAAAATCGAGATCTCCAAGCAATTCAT
CTTTTAGAGCAAGAGAGGTTGTTAGTTGTTCTAGCTTAATATCACAAGAGGCATGCAAATTTTTGAAAGAAGAGTATTCTTTAGACA
TTCTTTTAAATTCAAAGTTCAACTCTTCTAAAGCCATAGCTATGTCACATTGCATATAAAAAGATTCACTTTCGGCCTCGGNATATT
ACCTCATCTTCATTTGCCATGAAACAAACATTTGGGTTATGAAGAGCAAGTTTGGCTCCTTCTTCATCACTATCCGAGTCACTTGGT
TCGGATTCTTCCCATCCGGCATACATAGCCTTCTTCTTCTTGTACTTCATGTACTTTTCTTTGACCTTGGGGCAATCCTTAGCGATG
TGACCCGGTTCATTGCACTCAAAACATTTACCTACACGAGAGGAAAACTTGTTGTTAGATCGAGGGTTAAATTTTTTGTTCACTTTT
TATAAGTCTAGAGATTCTTCTAGAGAGATGAGCCACTTCTCTAGAAAAATCAACTTCACTCTCCGACGACGAAGATGAGTTGTCACT
AGCTCCTTTGAGAGCTATGGTCTTCAACTTTGGTGACGGCTCCTCAACTTCTCGTGATGGCACTTCCTCCTTCTCCTTCCCCTTGAG
CTTCTTCTCATGCACTTTGAGCTTTCCGATGAGACTATCAAGAGCTAAGGTAGTGAGGTCATGAGCTTCCTCAATGGCGTAGCCTT
GGGCTCCCATGCCGGAGTCAATGAGCGAAGTATCTTGTAGTTCATCTCTTGAATGGATAATTGCTTATCTAGACCATGTAATTCATT
GATGATATTAGTAAAACGGGAAAACATAGCATCAATGGATTCATTTGGAAGCATTTTAAATAGCTCATAATCATGCATGAGTCCACT
AATCTTAGATTCCTTAACTTGGGGTGTTCCTTTATGTGTGACACATAATTTTTGCCAAATTTCGTATGCGGTTGCACACGTGGAAAC
CCTATTGTATTCATTTGGGGAAAGACCACATATTAAGGCGTTCATGGCCTTAGCATTGAGATTGGCAAGGTGCCTTTCATCATCGGA
CATGTTCTCAATTTTGGACTTCTCTACATATTTCTTTTCTATGAGCCCTAGGATGTCAAGATCAATGCAACGAAGGTAAATTCTCAT
TCTAGCCTTCCAATAAGCAAAATTAGTCCCTGTGAAGACTGGTGGTCTAGTTGTGGATTGTCCTTCTAACATATGCATATTCAAAGA
GGCCTCCATTAGATCTTTTCTCTAAGGTGATTAAACTAAAAATTAATATAGAGACCAAGCTCTGATACCAATTGTTGGACCCTAGAG
GGGGGTGATTAGGGTCAAGAGGCTCTAATATGCAATATAAATTCAGCACAAGCAAGACACAAAACAAAAATGCGATAAAAGTAAGA
GAGATAGGGTTAGGAGTTCGTTATCCTTGACGCGCGATGTGTTAACGAGGTTCGGCCCTCTGGCCTACGTCCCCGCTCCCCACTCTC
GAGGAGAAATCCACTACACACCCGGTTTGGAAGCCGGAACTTCGTCTACACAGCGATCTCCACAGATCTCTTTCACTACACAGTTTG
ATCTCAACAGATCACACTCCCTCACAGTAGATCTTCACAGATCTCACTAATCACAGCAGAAGAAAAGATGCAAGAACCTCTCTTTAC
ACAGCCCCTATAGCAAAGAGAAGGTTTACTGAAGCTGGGAAGTGAAACACACTTAAAACAGAGAGAAAACAGGCTTTGAAAATTTTT
CTCAGGAAACAGAACGCTCTCTCTGGTTTTTGCAAACGTTAGGGCTAAAAAGAAGAAGAAGTCTGGGGGGTTTTTATAGAAGAGTTT
AAATCATTTTAAAACAAAACCCTATCTTCCCAAATGAGCAAGTAATCTCCTTTTCAGACTCCCAGCCCAGACTGTGCCAATCACCAT
TAAGTGAAAGCACAGTGATCAAGGCAGAAGACCGTTTTAAAAAAGTCGCGGTTGACTGAAGGAAATTTCGGTCGTCCGAAATAAACC
TTCGGTCGACCGAAAAATCACGTCGGTCGACCGACCGAAAAATTCGGTCGACCGCGAGCTGCTTCGAAAACTTGGAAAACAAACAGA
ACCANTCGTCGGTCGACCGGCACGGTCGACCGATTTGAAAATCAAGATTTCGGTCGACCGTACCGGTCAACCGACGACCTCTCTGGA
AAATAGTGAGGAAAGGCGATGGCAGCGGTCGACCGGACCGGTCGACCGCTTTCTGACATTTTGCAGAAAACAGTTTTTGACCAACTT
TAAATATTTGCAAAATATTTATTTGACCTCTGAAAAATCTGAAACTTTGTAAAATGTTTTTAATACTAAAAACAAACTGTTTGGAAA
AAGAATTTTGCAGATAGGTCCTCATACTTGTGAAAAATAGTATTTTGTGAAAAACGCTTAAAAACATAAGTATGAAATCGTGTGTGT

Fig. 13P

GATTCCCAATAGCTTCAAGTAAACTTAGTAACTCTTTGCCTACATTCTAGCACTAGAGAGGGAAACAAAAGAAAGCTAATATCCTCA
TATAGAGACCAATACTTGAGCTTTGATATAGCTTGAATCGGAAGAAGCTTTTAGTCGAATTTGACGTTCTTGAAATAACGTTGCTTC
ATCTCTTGCCCTCCTCCTCCTTTGGATATCTTCGTTGTAGCGTATATTCCATCCATCCTCCGTTAATGGCACTAACGAGCTTGATAA
ATGAATTTGCTACATTTTCACTCAATAAACTATTAGTACCGATAATGGTGGTTGTAAAATATCATCAAAACATAAGGCTAACACTG
TGAGCACTGTGTTCTTGCCAAGAAGACGAAGGTGAAGTTTGGGACAGTCATTCATAGGACGAGAGGCATCCTGGATTATGTGCACAC
AGATGTTTGGGTCCCACCAAGACTGCATCACTTGGTGGTAGATATCGGTTTGTCATGTTTGTTGATGACTATTCTAAGCGTTGTTGG
GAGTACACCATGGTGAAGAAGAGTAAAGTCCTAGATATATTTGTGGAGTGAAAGAAGAGGTTGGAACTCCAGACTGGGAGAAAGATC
AAGACGTTACGATCCGATAACGGTGATGAGTACACATCAGACCCCTTTCAGCAGTTATGTCGAGACGAGGGCATAGAGAGACACTTC
ACAGTTAGTCAAACACCACAGTAGAATGGGGTAGCAGAGAGGTTAAATCGGTCTTTGTTGGAGAAGATACGATGTTTGTTGGCACAT
AGTAGTTTGGAGAAGATCTTTTGGGCTGAGGCCTTTCATATGCAAGCCACCTCATTAACAGGATGCCTTCATCTGCGATTGAGGGA
AGACCCCTATGGAGATGTGATCGGGAGAGCCAGCACACGATTATGACTAGCTCAAGGTATTTGGGTGCCCTGCATACTATCATGTGA
AGACTAATAAGTTGGAACCTCGAGCTAGGAAGGTCATATTTATAGGATTCAAGCTTGGTGTCAAGGGATACAAGCTTTGAGATCCAG
TTGATAGGAAGATTGTGCTAAGGAGAGATATCACGTTCGATGAGTGTTGGGTCAAAAAATTGATGTTGGGATTGATTTTCTTGTTTT
AAGAAATAGGTTCAATCACTTGGTACGAAACCCTTACAATCACTCACCGCTCTCTCTCGATTACAGATGAAGAGAAGATTAATTCATC
TTCTCTTTTGTTTAACGTGGGTTCTAGGTGGTGATGCGGCATAATTATGTACCAAAATTGCAAGTGCACAATTGATCAAGTTATAGT
ATAAAAAGTTATCGATCCCACGAGGAAGATGATTTTAAGAGATTATTAGAATTGGTTCTTATGTTTTATGCNCTTCTCTTTTTATCA
TAATTCAACTTAGATTTATTAAGTATAGACTATCAAACCATTTAAGGAAAGTATAACCTATCAAATTATCATCTAAGTTAAAATTAC
TATTCATGATAAGAACAACAATAAGATAATAATCCTAGAATTCATAAGCATAACCTATCAAACCATTTAAGATAAGTATAGATTATC
AAATTCTTCTTCTACCGATTAGTTCTCTAGTTGATTATCCTAAACATGAACATTTTAAGTGAAAGAGAAAAATTCATACAATATAAA
GGAAATTAGACTAGTTTTATGCAATTCTAAGATTCCTACAAGAATTAATTTCACATCTTAAGAAATAAAAAAAAAGAAGAAAAAAAGA
ACTAATTACAAAAATAAAAAGAAAAGAAAAATCTAAACAATGAACAAGAAATAAATCTAACTACAAAGAATAAAAATCTAAAAGACA
AAATAAATTACAGAAATTAAATGCAAGAAAAATAAATCTACTCTACAAAATAAAGTACAAAAAGAAATAAAAAGACAAGAAAAATAAAT
CTACACTACAAGCATAAATGTAAATCTAACTAATAAGCAATAATAAAGAAATTACTAAAAACAAATAAAAAAAGAAAAATAAAAGAA
ATACAAACCTTCAAATTGCTCTTCATCTCCATCCTCATCATTCAACAAAGAGGAGAAAAGAAAATTTAAAGAGGAGAAAAAATTACTA
TTATTAATTGCAATAAAAGTTACAATTTTTGGAAGGCCTTCTCAATTAAGAGTAGCCCTCCTCTCCAAATAGAGTTACAAAATTTTT
CACACCCTTAACCCCTCACTCTCTACCCCTATTTATAGTAAACATCAGTGAATGAGAGCCATTGGATTGAAATCTTATCCAAAAATA
ACAAATTTCAGCCTTAGATCTATAACAAACTGTACGATGGCATCGATGCAGGCATCGATACAAGCATCGATGCAGGCATCAATACAG
GCATCGATGCAGGCATCGATGCCTACCTTCTTCTGGTTGCTGTCCGCAGAACTCTTGTATTTGGCTTTTGGCTTGTATCTTGGGCT
TTGGCTTAGACTTTTGGGCTTGGCATTTTCTCTTGATTTTCCATTGGGCTTTGAATTATTTCTTCATTAAAATATTTGAAAGAATTCC
TTTGGCTTCATGGGCTTCATTTCTTTATTAAATCGAGGGCTTTTTGTTGAGAGATGAGAGTTTGGGCTCTTATTCTTCATTAACCTA
CAATTAAAGATAAAAGCAATTCTTAGTGGTATATTTATTCATATAAAATAGATAATGAGGGTATAAAATTGTAATAAAAATGTGATTA
TCAAATACCCCCACACCTAAACTTTTGCTAGTCCTCTAGCAAAGAAAATAAAAAGAAAATCCTAACTCACTTTCGCAGGAATCGAGG
TTGTATTTAGCGCATACAACTAGCCTTTAAACCCCTAGGTTACCCTAGTGGACGAGTTGTAGTCTCGTGAGGGTTTGCGGTGATATA
CCCATAAAATTCGGTCAACTTGCCAAGTTAAATAAGTCAGTAAATAACAGATTTTCCTTGATATATTTAAACATTCTAATTGAAGCT
AGTTAATAATCAAGAAAACGTTTTTATATATAACTCCAATGTAAATCCCCTAGAAAATCTTTTTCATTATAGCAATACAAAACCAAG
TCAAATCTTAGAAATTTAATTAAAAAGTTTTGAAAAGAACATGCCAACTCTTTGTTTTAAATAACTTTCAAGTCTCTTGATCAAAAA
TTGTTTTTCAAGACCATATATACAAAACAACAATATATATATATAAACAATGGTTAGTGTTATATATATTTTTTTTTTCACTCTCTA
ATTCTTGGTGATTGTTTTCTATTTTAACGGGCTTTCTAAGTGACCATTTAATGAGTTTTGGGCCAATGAATCCCAACCCAATTGGGC
TTAGGTCATGAAGTATAGAGATACTCCTTGGGCTTAATTACTCAGTCAACTTAGGCTTTATAAGATAGAATCACCTTGAATTTAAGA
GTTTTTTTTTTGTGCCCATTTTTTGCACTCTTCTTTTATAAGGTTAGTTTTTTTTATATATGTGTGTAAGTATATATAGTCTGAAAA
AAGTGTGTAAATCAAGATAACTTGAAAAAAAATATTTTCAACTCTGAGTTAAGCATGGAAAAATTTTATTATTTTTAATTAAAAAAT
CTAAGATAAGACTTAAGTAAAGTATACTACTTGAAAAATTATTTCTTAAGAATTTTATTTGGAGTTATAATAAAAGGTGAACTTGAG
TATGTCACTAACTAAGGATTAGAAAATTTAAAATCTATCAATTAGATCAATTATTACTTAACTCTATTAATTTGGTAAGTGAAAAAA
AAAATTTTAAACTAACAAAAGATAAATGCTGAGAGAGAAAAAAACTGAAACAAAATACTAATTAGAAAAATATAAACAAAAGCTAAC
TAGCTTATACCCCCATACCCAGACTTTGCAGTGTCCTCAAGGCAAATAATATCTAGAATATCACAGTTTAATAAGTACATGCCGAAA
TAAAAATCAAAGACAGGGTAAAATAAAAAGAACATCCCTCACTGCTCATCTCCTGATATATCGTCATCCACATCATCAGCGGCAGCT
GCTGAACTCGGTCCCGCCTCATCCTCTCTTGGGAAATCATCTGGCTGAAATGGTGTGATATAACTATGAAGCTCAGGTAGAGGTCCA
TCTGTATCTCCATGTTCTCTCTGCCATCCTCTCACCAAATATGCCAGGGTATCAGTGGAGTATCTCATCTGACCATGTATCTCGTGT
ATATTCCGCTGCATCCTGTGCATCTGTATCTGCATCCTATCCATGTGACTCCGCATTCTGTCCATCTCCTCTCGAATAGGATCCTGT
GTAACTGGCTGGTGCTGAGGAGGCTCTCTACCTGAAGGACCGGACTGATCTCGCCCTGAAATGCTCCTCCTCACAGTCTGATCATTT
AGTAACCCCTTCCCTCCTTCTAACCTATCCTCTGCGAACACTGGAACGTGAAATCTATGGCAGAGTTTAGTGATAAAATAGGGGTAA
ATGAGCTGAGTACGTGATGCAGACTGTGTTCTGACCCAATCCAACACATTCTCCACTGATGAGCGCATACATACAAATATAATCCTC
GCTATATCAAATCGCAAACCAGTGGCTATCCAAAAGAGAAGGAGAATATCGTGTGGGGTAATGACAGAGTATGTAGTGGTGGGTTTC
AAATCAAAGTTCAGGAAAAGATTAAGTAATCTATATTCTGGTTTGAGATTTCCTGAACCGAAACTAGATGTAAAGATCCTCCCACAC
AAGGTTGCAGACATGTTGTTGTATTCTAGTGTACCAGGCTGTAATGTGGAGGCTAAATGGAAGTAATCTGGTACATCAGTGGGTGGT
TCTGCAAGGTCAAGGGTAGCACGGATAGTGGAAAGATCGAAAATAACCCTAACACCCCTCACGATAGAAAAAGCTGAAAATTCTCTA
TCTGGATTAATTTCCCATCCAGAATAGAACTCATGCACTAATGAAATGTTTGCTTTTTCTAAGGGTTTAGTCATCATGCTCCTAAGA
CCTACTGCAGTTAACATGGTGACTGTGGAATGATATGTATGTAATGCACTCATCTGAAATCCCCTCTCAAAATGAATGTTAAGACCC
ATAATTTTGGCTAAAATAGTGGGTCTATCTATGTCGGTATCAGATGGATCAGAAGATGATGAAGTTGCTCGAAATTTCTTTCTGGGG
GCATCTACAGAAAAAGAAAGAAAAGAAAAAAATTTAATAACAAAATTCCAATATTATTATTTACTTATTATTATTTTATTTTTATT

Fig. 13Q

TTTTGACAAGAATTTAGCTACAAATTGTTCAACATGAGTTAATTTCAAGTTATCAGAATTTTGTTTTGACAAAAAATTTCCTCAAAA
TTGTTCTTTTAGAACAACAATGTTAAAATTTTGATAACTTGATCGATGAAATCCACATGTTGATATTACAATTATAAGCTAAACCTT
AATTTTTTTTTTGGAATTGTTTGCACATAACACCCTAAATTCAAGTTTTTTTTTTGAAATCACGTACTCAATTGAATGTTCAAAAAG
TATTTGTTTTTGCACAAAAACCCTAAGAATTTTCGGGTTTGCATGAAACACCCCAAATTTTTTCGGTTTTGCACAAAACACCCCAAA
ATATTTTTTTTTTTCAAATTTTTGTACAAGATATCCTCAATTGAGTTCTAAGTTCAAACCCCCTAGAAATTTTCGAATTTTGCATAAA
TCCCCCCAATATTTCGGATTTTTTTTTTTTGAACAAAATCCCCAAATTTTGGCAAATCCCCAAATTAAACCCTAAATTTACTAAATT
GATCATGAATCAACACAAAATATGATAATCATTCACAACTACCTATGATTCAATCACCAAATCATCCATGTATTCATAAAAATTATA
AGATCAAGTTAGAAACAATACATTGGGTAGATGAGTGGAGGTGGAAGAAGGCCAAAAATAGTGAAGAAATCTCCTCCTTGTGATCTT
GATCTTGTGTGGGGGGGATTAGGGTTTGAGGGGGAAAAAAATCGGGTTTGGGAGTTGAAAGAAAGAGGAGAAGAAAGTGGCTTGGGG
TGGGGCTGCGGTTTTAAAAGCTGCTGGGTGGAGGCATCGATGCGGGCATCGATGCGGGCATCGATGCCCCGAACCATGGTGTTTGGC
CCAGCCGGCCCAAACACGGTTTCTTTAATTTTTTTTCTTTTGGCCTGATTTGTGGGCCAACACTTATTTTATCTTTTTATTTTTCT
TTTTTTTTTGTTAGGCCTATGTTACTTATTCAAATTTTGTTGTTTTGTTTTGTTNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNAATGAGG
AAATATGTATATATATGTCTTTTTTTTGAATTTTTTTTTTTTACAGATAATGAGGTTCATGAAGAACCAACACCTCTTCCTCTTCGAA
CGTAAAAAATTCTAAAAATGGTTTCAGACGTTGACCATTTGTTTTAAAAATGTTACCATTTTTAGGATTTTCTATCTCGACAGCCCC
ATGCCGAAAAAACTTGTTTGATAAAAAATGGACCTGTCCATCTTGATCTTAATTTTCTAGGAAAAAGATGTAATTTTGAATTATACAA
TAAAACTTTCTGTCCTGGAGAGAATTTTTTTTTTTTGTAAAATTGATTTATCATGAAAAATTTTGGTTTTCTCTTTGTAAATTTTTG
AGTTTATGTATGCATCATTTCTAATTTCTTCCAACTCATTTATTTGGAGCAATCTGTTCTTACTTGCCGAGTCTGAGTTAAAATTTA
ACTGTTTTATTGCCCACATTGCTCGATGCTCCAACTCCACTGGTAGGTGACAAGCTTTTCCAAACACTAGTCTGTATGGTGACATCC
CCAAATTGGCCTTGAAAGCTATTCTATACGCCCACAGAGCATCACATAATTTTACAGACCAATCTTTTCTGTTATGATTAACTGTTT
TTTCTAAGATTTTTTTGATCTGCCTGTTTGTGACCTCTAAGTTTGAGCCCGTGCGCTGTGCCGGCATTACTAACCCCTAAGAAAGAT
GGTTCATGGAGAATGTGTGTTGATAGTCGAGCAATCAATAAGATCACCGTGAAATATCGGTTTCCTATTCCCAGACTAGATGATATG
TTAGATATGATGTCTGGAGCCACCATATTTTCCAAAATTGATTTAAAGAGTGGCTACCATCAAATTAGGATTCGTCTAGGGGATGAG
TGGAAGACAGCTTTTAAGACGAAAGATGGTCTATACGAGTGGATGGTCATGCCTTTTGGGTTGACAAATGCTCCCAGCACCTTCATG
CGAGTTATGACTCAGGTACTACGACCTTTTATGGGTAAATTTTTGGTCGTTTACTTTGATGATATCTTAATTTATAGTAAATCGTTG
GAGCATCATATTGACCATCTTAGTCAAGTCTGTCTCACTTTGAGGAAAGAGAAGTTATTTGCAAATCCCAAGAAATGTGTTTTCATG
ACTGACCAAGTTATATTTTTGGGATTTGTTGTGTCTTCTCAAGGAGTTTCTGCTGACCCTCAAAAGGTTCAGGCAATTGTAGAGTGG
CCCGAGCCCCGGAGTATCCGAGATGTAAGAAGTTTTCATGGGCTCGCAACTTTCTACAGACGATTTATCAAGGAGTTTAGTGCTATC
ATGGCCCCAATTACGGATTGCCTAAAAAAAGAGGAATTTCGTTGGTCCGAAGAAGCTGCCACGGCTTTCAAAGAAATTAAGCAGCGA
ATGACCGATGCACCTGTTATGAGACTTCCTGATTTCTCTAAGGTATTTGAGGTCGCGTGTGACGCCTCGGGCATTGGTATAGGTGGA
GTATTGAGCCAGGAGAAGCACCCCATTGCTTACTTTAGTGCAAAACTTAGTGGTGCTAAGCTGAACTACTCTACCTACGATAAGGAG
TTCTATGCGGTTGTACAATCATTGCGCCATTGGCGACATTATCTTTTACCACAAGAATTTGTTATTTATTCGGACCATGAAGCCCTT
CGGTATCTTAACTCTCAGAAGAAACTCAATGCCAGGCGTGCTCGATGGGTTGAATTTCTACAAGACTACACTTATACCCTCAAACAC
ATGGCTGGAGTTGAGAACAAGGTGGCTGATGCACTCAGTCGTTGAGCTTGTCTTCTAAACCGCATGAGTGCAGAGGTACTGGGCTTC
GAAAGAATCAAAGGGGAGTATGAATCATGCCCCGACTTTGGAGAGATTTTTGTTTCTTTAAAAGGAGTGACTTCCGAGATAGATGGC
TTTTTGTTCCAAGATGGCTATTTATTTCGATTTCGCAAGTTATGCATTCCGCGTACTTCTTTAAGAGATTATCTTGTTTGGGAATTG
CATGCAGGAGGCCTTGCTGGTCATTTTGGTCATGAAAAGACTATAGAGGCGGTAGAAACTTTGTTTTACTGGCCAAGCCTTAAAAGA
GATGTTGCAAAGTTAATAGGACAATGTCGCACTTGCCAATTAGCGAAGCAACGTAAACAAAATACTGGCCTATACACACCTCTCCCT
GTTCCAGATCGTCCTTGGCAGGATGTAAGTATGGATTTCGTGTTGGGACTTCCTAAAACTATCAGAAAACATGACTCCATTTTTGTA
GTTGTGGATCGCTTTTCAAAGATGGCCCACTTCTTGCCATGCAACAAAACGTCTGATGCATCCAAAATTGCTCGGATCTACTTTGAT
GGTGTGGTCAAATTGCATGGTTTGCCCAAAACCATTGTATCAGACAGGGATGTAAAGTTTATGAGTTATTTTTGGAAAACTCTATGG
CACAAGATGGGAACTAAACTTCAGTATTCGTCTGCTTTTCATCCCCAAACTGATGGTCAAACTCAGGTAGTTAATAGGAGTCTAGGC
AATCTTTTGCGCTGTTTGGTTGGTGAGAATTTAAGAAATTGGGATCTTCTGTTATCCACTGCAGAGTTTGCATACAATAGCTCAGTC
AATAGGTCTGTAGGCATGAGTCCATTTGAAGTTGTGCATGGTTACAAGCCTAGGAAGCCTATAGACCTTATTCCCATGTCGCATCAT
CCTAGGGTGTCCGAGTCAGCAGTTGCATTTGCATCACACATTCATGATTTGCATCAAGAAATCAACAAGAAAATTCAAGAAAGCAAT
GAACAATATAAATCTCATGCTGATTTACATAGAAGACATCTTGAGTTTAACGAAGGTGATTATGTAATGATCCGAATTCGCCCAGAA
CGGTTTCCTCCTGGAGCCGTCAAGAAATTACATGCTCGTAGTGCTGGACCTTTTAAGATTATCAAGAAAATTAACTCAAATGCTTAT
GTAATCGATTTACCTCCAGATTTTGGAATTAGTTCGACATTTAATATTGCAGATTTGGTAGCTTATAAAGGTCCTCCTTTTAACCCT
GAAAATCCACTTGTGGATCTTGATGAGCCTACCCCTGATCCTTTCCTTGAGGCACCCCCATTGCCACCACTGCCTACTACTTTTGTC
CCATTTACAGCTGAACAGATTGATAGCATTCGGGATGATCAAATCATCTCAACCCGAGATGGTGGTTGCAGACGATATCTAGTACGT
TGGAAAGATCGTCCTGAATCTGATGATACATGGATTACTCGTGAGGACCTACAGCGCCTGGCTCCGGATCTATTGGAGTATTATGAG
GGCCAGTTGGAGCCTAACTCGACGGGGTCGAGTTCTTCCCACCCCGGGGGAATTGATGAGGACATCGCACAGCCTCCACTTCGCACA
TATTTTCGCCGCCGTCGTCGTCTTGCTTCAGCTTATATTTGGTTTTGATTTTGAGAAGGCTTGGAGTCTAGCTAGTGTTACGTTTAT
TCTCTTTATTGTATTTGCTCTTTTTTTAGTCCCACATCGGATATGGGAGTGAACTTGTAGTTGTTGAAGGCCTATTTAAAGAGGTCA
ATTCTATGGAATAAATCAATGAATATTTGAAGAAAATTTCGTTTCATTTGTGAAACTTTGGGTAATTGATTTGATCTCTAAGATTGA
GTCAATGGTGGTGAAGCCAAGGCCCGGGTTGCGATTCGTGGTCATATCTTGTTAATCTTTCAAACCCTAGTTTTCCCCAAATCTTTG
TTCTTCCCCAAATTTCCCAAATCCCTTACATAAAACCCTAAAAGTCCCATCGTCCCGCATCAACTTGTCCACTGCTTTGGGGGTGAT

Fig. 13R

AAGGAGTTGACAATTTGTGTGTGATTGAATATTTTCTCATCAAAGCTTCGAAAGAACGGTTACAGAAATGTGTACCGTTATCACTGA
TGATCGCTCGGGGTACTCCAAACCGTGCAAAAATGTTCTCTTTCAAAAACTTGACAACGACCTTGTTTTTATTAGTTTTGCAAGCTA
CCGCCTCAACCCATTTTGACATGTATTCAACGGCTACTAGAAAGTAAACATTTCCAAAGGAATTTGGAAATGGTCCCATGAAATCGA
TACCCCACAGATCAAAAACTTCAACAGATAAGATGGGTTGTAAGGGCATCATATTTCTTCTAGTGACCTTCCCTAAAAGCTGACAGC
GGTTAGAGTTTTGCAAAACTCGAATGAATCCTTGAAGAGAGTAGGCCAATACAGCCCAGATTGAAGAACTTTTTTAGCTGTTTTTCT
CGGGCCAAAGTGGCCCCCACATGCTTGCTCATGGCAAAATGATAGAACACTCCTAGTTTCTTCAGTGGGAACACACCTCCTAAAGAT
ATGATCAGAACAGTATTTGAACAGATATGGATCATCCCAGTAAAAGTATTTTACTTAGGAGAGAAAACATGATCTATCCTGTTTGGA
CCAATGAGAAGGGATCTGGTTCATGACTATGTAATTCACAATGTCAGTGAACCATGGAACAGATTGGATTTGTAGGAGTTGTTCATC
AGGGAAATGCTCATTGATCAGAACGGTTAATGTTGGTGCGTTCTGTAGTCGAGAAAGGTGATCTGCTACGGGGTTCTCTGTTTCCCT
TCTGTCAAGAATTTGGATGTCAAACTCTTGAAGAAGGAGAATCCATCTAATGAGCCGTGCTTTAGCATTCTTTTTGGTCAAAATATA
CTTTACTGCGGCATGATCTGTGAAAACTTTGGTTAAGAAACCGATGAGGTAGGACCTGAATTTTTCTAAGGCAAAGACTACAGCTAA
AAACTCTTTTTCTGTGACAGAATAATTTTGTTGGGCATCATTCAGATTCCTACTGGCGTAGTAGATCACATGCGGTTTTTCGTTAAA
CTGTTGTCCTAAAACAGCTCCAATCGCAAAATCAGATGCATCACACATCAGTTCGAAGGGTAAGATCTAGTCTGGTGCATGAATGAT
AGGAGCTGTGGTTAGCTCCTTTTTCAGATATTCGAAAGCTTTGAGGCAGTCGGGGGAGAAGACAAATGATCGATGTATCCTTAGCTA
AGAGATTGGTCAAGGTCTAGCAATTTTGCTAAAATCCTTGATGAAACGTCGGTAAAAACCAGCATGACCAAGAAACGATCTGACAT
CTTTGACAGTTTTGGGAGGAGGGAGATTAGAAATGAGATCTACCTTAGCTTTGTCCACTTCAATTCCCCTATTGGAAACTACATGTC
CTAAGACAATGCCTTGTTTGACCATGAAATGACATTTCTCCCAATTGACAGTCAGATTTTTCTCCCTACACCGTTCTAAGACCAATT
TAAGATGATGCAAACATTGGGAAAATGTGTCACCAAAGATGGAAAAGTCATCCACGAAAATTTTGAGAAATCGCTCTACCATGTCGA
AAAAAATACTGATCATGCAACGTTGGAATGTGGCCGGTACGTTACACAGTCCAAAGGCATGCATCGGTTTAAGTTATCCTACACCT
AGCTGTTGATAGACCGAATAAGGAAGGAGGTTGACGCTGGCTTCCAAGTCTAGAAGTGCCTTATCAATGTGAGTGTTATCTATGACG
CATGGAATTGTGGACAACCAGGGTCCTTGTATTTCAACGGCATGGGTTTTGAAAAAATTTCACTAAGGTTGGCAGCTAAGAAGACT
TTCTTGGGGACGTTGGTGATTCTTTTCTTAGTGCATAAGTCCTTCAAGAACTTTGCATAAGAAGGGATTTGTTTGATTGCATCTAGG
AGAGGGATGTTGATCTTGACATGTTTAAATGTTTCTAGGATTTTCTCAACCTGCGGGGAGTTTTTTCTAGGTTTGAGTCTATCTGGA
AAGGGGCAACGGGCCTATACCTATCTAGATCAGGTTCAATCTCAAGTTCAGCGCTTTGGTCATCGGAAGGAATTGCTTCATCAGAA
GGAGTTTGTTGGATGGGAGAAGGGGTTTGATCCGGTGGCATTCTAACTTGGTTGTCTATTTGTTTTCCTGATCGCAGTGTGTGAACT
ACATTCAATTAAGCTGGATTGTTGGAACTGGATCCAGTGTCTTTAGGGTTTGTAACAGGTTGACTTAGGAATTTTCCTTTTTCTCTC
TCACTTACGGTAGTGGCTAGTTGCCCAAGTTGGGTTTCTAACCGAGCTATGGCTTGAGTGTTTGAGTTAGCACTTGGCCGGTTGTT
TGCATGAAAGAATTTAGAGTGGTGGATGAATGGGTCAACATGTTGGTCGTTTGTGTAGAACCTTTCATCATAACTTCTAAACCCTTT
TCTAAGACACTCAAATGTTTGTCATGATCAGAATTTGAAGGATTTGTAGGCTGGTGAGGATGAGGATGTTGGTTTGGAAAAATAGGG
TTAGCTTTTTGAAAATTGTTTGGTGCGTTGAATGGGACAGTGTTTCCCCTAGGGAATTGGTTGGTTCGACGCGGGAATGAAGTTTTGG
TTTCCATGAGAATTTCCTTGGTTCCAAGCAAAGTTAGGATGATTTCTCCAACCTGGATTGTAGGTTGGAGAAAATGGATCATTTCTA
GGGTGCTGGAATGCAGCGTTCATTTGTTCTAAAGCATGGTTGTTTCCTAGGAGAGGGCATTCCTCTGAAACATGGGTAGAAGACTGA
CAGTTATGACATCCCGGGGCAAAAATATGATTGATTTGAGCTGGAGCTCGCTCCTTAACTTCTAAGGCTTCTAACCTCCGCAGAATT
GTCGCCATCTTTGCTTCAGAAGCAATGTTTGACTCCAGGGAAAGACCACTAGACTTAGATTGGGAAACAGATAAAACCCTATCATCA
TAGTTTTTCCACTGCATTGTTTTCTCGGATAGACTCTCTAGGAATTCCCAAGCTTCATCGGCGTTTTTCCTCATAAAATCTCCCTGA
CACATCGATTCTAAAGATGTTTTTGAAGAATAGTCCAATCCTTCATATATGACTTGGCACAGTCACCATTTTTCTAGACCGTGATGA
GGACATTGGATTAAAAGATCTTTAAATCGGTCAAAATATTTCCAGAATGGCTCCGCTGGGACAATTTTGAAGTTTTGAATACTGTTC
CTAAGCTTTACCGTTTTATGAATAGGGAAAATTTTTTTAAGAAAAACGGTGACAAATTCCTCCCAAGTTGAGATAGAATTTATCGGT
AAGCTGTACAGCTATTTTTTAGGTTTGTCCTTAAGAGCAAATGGAATAAATCTAAGGTTAATCGCATCTTCAGTTAATTCTCTCATT
TTAATCATAATACATACTTCCTCAAATTCCGATATAAATATATATGCATCTTCTGTTTCATTACCAAGGAATTTGGAAGCATGTTT
ATGTAATGCGGTCTAAGCTCGAAATTTACTCCATTTACTTCGGGGAGTCTTATGCAAGATGGAATTGCATTTCTAGTGGGGTAACAC
ATAGCCTGAAGAACAGGTTGATTTGCCATTTCTTGGATTGGTTCAATACGGATTAAACGATGAGAATTATCCCGAACCCAAGTTTGC
ATACACCAAAACATTTTTTTTTNGAAGGAAGAAAATTAGTTTTTTCTTTTCTTTTAAGGAGAGAAAGAAACTTAGTTTTTTTTTAT
GAGAAGAAAAATCCTAACTAAAACAAATCAAATCAATCACTTTTCAATCACACTCTAATTCTAGGGTTTAGCCTAACTCAACTAGAC
CAGCTCCTAACCAAAAACTCCTACAGTGAAAAGATTAAAGTTTTACCCAGGTAGTTAGCCAGGTAAGGATAGTACTAGAGGTTGATC
AGAGATCAATTAAGTACCTCATTCCTTGCCGAGCGCTTTACGAAACCCCTAAACCTTGCCTTAGACACCAACTAATCTGAGAAAACT
TAAACTGGTTCACTTAAGGATTTCTTGTTCCTTATTGAGCTCGAATCCTTAGGGGCCAACGTCTAATGAGTTTTAGAAGGCTTGGGT
TATGAAGTGAGGAATTAGTGATTTGTGGGCTAAGGAAAGGGTGATGAAATCCCTTACCTTATCTTGATTGGGTTTTGCCCTTAAGA
ATGTTTTAAGTGTGTGCCAAATCAAGTGCTACAATCACTTTGGTGAATTCCTATACTATATGAAATGCAACCCTAGAAATTAAAAGC
GACTAAAAATGATGATAAAAGAAAATCTTTTTTTTTAATTATGGTCAACAACAATCAAATATGAGAAGAGGTCTCTTGTTTGAATT
TATTATCTTGTTAGTTAATGTCCAAGTGAAAGGTGGGTTTATTATGGTCAACAAAAATAAAATCTTTTTGTTTTTTTTTTAAATCC
TAAGTGTCTCTAATTGTGAAGCTAACTAAAAAGGGTAGAATTGAAAACTAAAAAGAGGACTTACCCGAAAGCAATTCTCTAAATTCT
TGATCTTCAATCCAAGACTTTCAAGCTCCAAGCGGTTCCTTCACAAGAAAACACACAAGTTAAAGAACCAAAATAATAAAATCCTAT
TTAAGCACCGTCCCCGGCAACGGCGCCAAAAACTTGATACGGCATAATTATGTACCAAAATTGCAAGTGCACAATTGATCAAGTTAT
AGTATAAAAAGTTATCGATCCCACGAGGAAGGTGATTTTAAGAGATTATTAGAATTGGTTCTTCTGTTTTGTGTNTTTCTATTTTTA
TCATAATTCAACTTAGATTTATTAAGCATAGACTATCAAACCATTTAAGAAAAGTATAACCTATCAAATTATCATCTAAGTCAAAAT
TACTATTCATGATAAGAACAATAATAAGATAATAATCCTAGAATTCATAAGCATAACCTATCAAACCATTTAAGATAAGTATAGATT
ATCAAATTCTTTTCTACCGATTAGTTCTCTAGTTGATTATCCTAAACATGAACATTTTAAGTGAAAGAGAATAATTCATACAATAT
AAAGGAAATTAGACTAGTTTTATGTAATTCTAAGATTCCTACAAGAATTAATTTCACATCTTAAGAAATAAAAAAAACAAGAAAAAA
GAACTAATTACAAAAATAAAAAGAAAAGAAAAATCTAAACTATGAACAAGAAATAAATCTAACTGCAAAGAATAAAAATCTAAACTA

Fig. 13 S

CAAAATAAATTGTAGAAATTAAATGCAAGAAAATAAATCTACTCTACAAAATAAAGTACAAAAAGAAATAAAAAGACAAGAAAATAA
ATCTACACTACAAGCATAAATGTAAATCTAACTAATAAGCAATAATAAAGAAATCACTAAAAAGAAATAAAAAAAGAAAAATAAAAG
AAATACAAACCTTCAAATTTCTCTTCATCTCCATCCTCATCATTCAACAAAGAGGAGAAAAGAAAATTTAAAGAGGAGAAAAATTAT
TATTATTAATTACAATAAAAGTTACAATTTTTGGAAGGCCTTCTCAATTAAGAGTAGCCCTCCTCTCCAAATAGAGTTACAAAATTT
TTCACACCCTTAACCCCTCACTCTCTATCCCTATTTATAGTAAACATCACTGAATGAGAGCTATTGGATTGAAATCTTATCCAAAAA
TAACAAATTTCAGCCTTAGATCTATAACAAACTGTACGATGGCATCGATGCAGGCATCGATACAGGCATCGATGCTGGCATCGATAT
AGGCATCGATGCCCCATCGATGCAGGCATCGATGCCTACCTTCTTCTGGTTGCTGTCCTCAGAACTCTTGTATTTGGCTTTTGGGC
TTGTATCTTGGGCTTTGGCTTGGACTTTTGGGCTTGGCATTTTCTCTTGATTTTCCATTGGGCTTTGAATTATTTCTTCATTAAATA
TTTGAAAGAATTCCTTTGGCTTCATGGGCTTCATTTCTTTATTAAATCGAGGGCTTTTTATTGAGAGATGAGAGTTTGGGCTCTTAT
TCTTCATTAACCTGCAATTAAACATAAAAGCAATTATTAGTGGTATATTTATTCATATAAAATCGATAATGAGGGTATAAAATTGTA
ATAAAATGTGATTATCAGGTGGCGAAAGGATGCTTCCCCTGATGCTTGAGTCAAGCTTGCCTCCTGTTGACGATCAGACCAAGATCG
CAAGAGCTTCTGACGTAGGTTAACCAACTGGAATCGAGGTTCGAACTCCGGATTGACATGTAGAAACTTTAAACTCTGATGCATCTC
TAAGTCCAAG

>lcl|scaffold905
AACCGATAAACTGTTAACAAAGTAATCAATGGAATCAATAAAGAAAGCAACGGTTTTTCCCGCGAACACCTACCAGTCAATCACTCG
AGAAAAAACGAAGCAAAAAAAGTCTCCAAAGTAGTTTTAAACACTTCTTTATGGCTTCATTAGCAAACAAATTAAAGTTATGCCCTT
TTTTTTACTTGGCAAAAGGTTGTAACCAAAAGCATCCTTGAATAATTCGTGACCTTTCTTTGTCAAAATCAAGTAGGTAACCTAATT
TCTTCCACAAAGTTGTTAAGTTGGTTTTTTTTATTACACATTACGCACGTATTTTTTGGTGAATTTCACAAATATTTACAAAACTAA
AGGATACAACTTAATTAAACACTTTGAATACCTAAGCAACCAAAAACTACACTCTTAATCATCAAAATCTTACAATATTTTTTTTGC
CATGCCATTGATGGTGAGTACCTAAGAATCAAACATTTCACATCTTTTATATATATGAGAAAAATGGGTATGCTTGGTAGTGAGGTG
GCATATTCTCCTTCACTCATTGAAATTGGGGTCCACATTCACGTAGGTTGGGGAGCGATTGAGAATTGGAATGAGTGGATGAGAATT
GGACACCTCACTACAAAACATACTCATCTCTCTCTCTCTCTCTCTCTCTCTCTCTCTCTCTCTCACTATATATATATATATATAT
ACACACACACACACACACACACACACACACACACACACACANNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNN
AAATTTACAGGTTTCGAGTCTTAGCCATTTACCTACGGACGATCCGAGATAAGAAGTTATACACATGAATTTCACAAAGTCAAGAG
ATTTGTCTTAAAAAGAACGGGGAAAAAGTAAAAATATATAAAAGGATATAGAATGTAAAGGAGAAAGCCATAGAGAAACTCCGGCTT
CTTCAGTCTTCAATGGAAAGATTTATTTATTTATTTATACCATAAATAAATAGAAGAATTGTACGTAATTTTCAAACCAACTTTCTA
ATAACCCGTGAATGATATAGAGCGCTCCTTTTCTACGTGGTGCTAATAGAATCCTTACTCAAATGTGGATATATATCTAATATTATA
TTAAAATCCTTAATTAATTTGTCTTTCCATGTGAATTTATAAAATGTTTTTTATCCTGAAATCTTCATATTGTACATGTGTCTAGTT
TTCACACAAGGGAAAAGCATGCATGAACAATGTCAAACAATTGATCACTTAAGAAATATAGAGTTAACCTACTTCGTTGGCACGTAC
GTAGAGACAACTTCCCAAATTCTACGGATGCCGAACTTTGTTATTTTGACAGATCTACATCTTAGTTACCTAAAACCTAGCTAGTTT
CATATTGTATGACACGCACACGCACACATCAAACCCCTATTAATTATAAACATTATATATAGAGTAATGCTAATAAATTATAAATTC
TGTCCTCCTCTTGTGTTACAAAACAGATCGACGGATATACATATATACATACATATATAAATTCTGTCCTCCTACATGTCTTCAGG
TTTCTCTTGTAACTCTAGCGCCATATAACCGAAGGATAGATGTATTTATAATCCAAAATTTTGTCCTAATATATTTTGGTTCAGGGA
TCTTAATTAAGCAGTGAATATAACTAGAAGTAGATATTCAAGTATTAATGCTCTGAGATATACAACTGGCCAGTACCGTTTATAGCT
CCACTACTAGCTAGATACTAATAAAATAGAAAAAAAATGATGATAAATACCTATGTATGTACGTATATACATAACCCTAGCGAGTAC
AAGCTAGGGACACCCTACTAAATATATATATACACGTGTGTGTGATATAAGACATGCAAGTACCTTAACTTACATATACATATAACA
ACAACATATAATAAATAAATTAATGAGACAAAACAAATGGCTAGTGCCGTATTCTAAAAACTCAACCCATGTTCAGGTGACCAAACT
GAACACAGGGCGGCTAATCTCACCTTCTCCACAAGAGAAAAACGCAACCCAGTTGGTCTTCGGCAGCTTTTGTCCTCTACTTTCAAA
GTTTAGTCGGTGAGCTCACCACCCTCCTCTTATCCTCACCCCTACTCGATCTTTTCTCTCTCTTTTTTCTTCAAAAAGAAAAGAAAC
CTTGATCAAGCTAGCTTGCTTTAATTTTTGTGAAGAGGTGAAGGTTAGGGTTTTGATGGCGGGCGGTCATAGATCATTTCATGGCTA
CCAAGATCAAGAAATGATCTCTTTTGGAATGATGAGTCAATCCTCTTCTTCTCATCCCAAGCATGAAAATTCCATGTAACTTATTTG
TCACTTTTATATGTTGTATCTTTTTGTTTGAAGTCAGTAAGAGCTAGATATAGAAAACCTTATAGTACATGCATGACTCAGTTTGTT
ATTTTCATTTTTTTTTTAAATTTTATGTGTGTATATCCTTTAGTTTAAGGTTCCACTTGTTAGGTAGGAAGAGTTTTTTGATTAATT
CTGTCTTTTTCGCCAAAATTAACACTTTGTTTGAATGAGTTTTTTGATTAATTCTGTCTTTTTCGGCAAAACTAACACTTTGTTTCA
TTCAAACACTAAAAATCTACAAGTTGTGATCATGATATATGTCCTTTTACACGTGATCAAAGTGAAGGCCTGGAAGAGCAGCTTGAT
CTAGTTCGTAACTTGATTAATTTACACTGAGGCCGGTATTATGTTTGCTTTGATATTTAACAGGCCAAACGAGGCAGGAAACTATG
ACATAGGGGAGTTGGATCAATCTCTTTTCTTGTATTTTGATGGGCATGATAATCCATCAGTTGATCAAGAGCATAAGCGTAAGTATC
TTCGATCAATTACTTTTTATCATCTTCTTATATTTGAATTTGATTTTATAAAAAAATTTCCCTTTTTAAGCTAATCTAATTGCATCT
TGAATGGTTTATGTTAATTTCCTTCGATTTAGAGTCATATGGAAGTGATAGTTGTACGAAGTCAAGTTTTTCATAATTCAGAGTAAC
TTTTTAGGGTTCCACAAGAGAAGTACGTAGATATGTGATTTAGTTTTCTTGAGCGTCCTAATATATATTTTTCTTATTAATTTTTGA
GTTTTTCCTAATTTGCAGGAACTATAAGTTCATTTCCCCCTCTCTATATTTAAACTTGTACTTTGTTACGTATGCAAATATTAATTC
TGAAAGTTGCACCTTCAGAAGGTTTAATGCTTGCAGGAATTAATTCATGTATGCAGAGACTCTTAACATTTTCCCTTCTGAGCCCAT
GAATATAGAACCATCAACCAAGGTTCGTATACACACATAAATGTGAATCAAATTAAACTAATATTATTCAATCTATTTAATTAATCC
TTCATTTATATCCTAAACTTAGTCTTTTCGCTAATCGTTTTTTTTCAGGTTGATCTTGGTTTACTCCCTTCAACAAGCAATTCTAAT

Fig. 13 T

TCTCAGAGATATAATATTGAACAACCAATGGAGCGTGATAATCCAAGAGCCGTTTCATCTTTGGCTGGAAAAGGGAAACATATTAAA
ACTTCACTAAAAGTACAGTTAGAACATGCACTTTAATTTATATCATGCATAAAAAAAAATTCAGTGACCCAATTAATTAGACATATA
ATTAATTATTCTTCCCTTCTGCAGAATGAAGAAAAGAACAAGAGCATAATAGCAAGTTCAGATCAAGAAGGGCCTAAAACCCCAGAT
GCCAAAGTGAGTCAACTAAATCATATTTTATGCAATTAAATCAACAAATTATAATAGCTTCATGATTCTTCTTGGTACAGACTTTGA
GAAGGCTTGCTCAAAATAGAGAAGCAGCAAGAAAAAGCAGGCTAAGGAAGAAAGTAAGCCAACCAGATGAATGAGACCTCTCGGTCTG
AAGTCTTAACCTACCATATTCTCCTAAATTTTGTTTTTTATTTTTCTTTCCCCAATTTACATTTTCCCCTCTCTTCTTTTTATTTAT
TAATTTGACAGGCTTATATTCAACAACTTGAAAATAGCAGGATCAAGCTACTCCACCTAGAACAAGAACTCCAAAGTACAAGAACTC
AGGTTAATTTCATATATATCTTCAACTCCATTTACATATATACTTCTAATATATATTATCTTATGCAACGATATATTTTTCTTAAAC
TTTGGTTTAAACCCCATTAATTGTTCTGGTATTATATATCTTAAAAATCTCTGATCTGTTACGACAAAATTTCGATTCATGCATGAC
GGTCTTAATTTTACATTTCTAACGTACCATATATCTCTTGTTGCCCTAATATTTGACCTGGAATTAATATTCGTCTTATTTTTTCTTT
ATAATACTTAATTAGTCTATGCTAATTGATATCCTAACCACCATTTACTTCTTGTAATTAATTAGGGCATGCTCATCAGTGGAGTAA
ACCAAAACCTTCCTCCAAACCCAAATGGGCTCACCTCAAGTACTAACCTTCCAAACCCTAAAACTTCATATATTAGTACTGTTATAC
ATATTTAATTTTTAACTAACCCTTCCAAAAAAAAATTCCCTATAATATATAATTAGATGCAGTTGCATTCAACATGGAGTATGAGAG
ATGGAAGGAGGAGCATCATCAGATGACGTGTGAGCTGCAGGCTGCAGTTCAAGAGAACCTCCCTGAAAGTGAGCTTAGGGCTTATGT
TGACAAATATTTGGGTCATTATGAGAAGATGATGAAGCTCAAGAGCGTGATTGTGAAGCTTGATGTGTTTCATATAGTTTCTGGGAT
GTGGGTTTCTCCTGCGGAGCGCTGCTTCTTGTGGATTGGAGGGTTTAGGCCTTCTCAGATTCTCAAGGTTCTTAATTTTATAGAAAT
CTTCATGGAACTTTATTTGATTAAATTCATTTCTTGGTATATTTATCCCTTATAAGTTTGACGGAATTTATCATATACTTCTTAATTA
ATTAATGTATAGGGTTTTGAGTTCATTAAAAGTTATAAAAATCGCTTCATTTATACAATGCTTTGTAGAAAATCAGTATCATTTAT
TAAACATAATAATAAATTTAATAACAAAATATTTTTCTACAGTTTTGATGGAATTAATAATAGTAAAAGTTGCTATGTGATAGTCAA
TTTCACACATTTTTTTCCAATTTTTTCAATATTATCTTCACATAAAATGATGGGATTATAAGAAAATATAGTAAAAATTGCAGCTGT
ATATATGAGAAGGTTTCTTTACTTGACAAGTAATATTGGTTTAAAGCAAGATGTAGATGAAGAATGTTTTATTTTTATTTTTATTT
TTTACTTTTTGTGAGAAAAATATGAGATGTAATCACTTCACCTCCTAGTGAAGGGATCAAGCTCGAGGATTTATTTTCCACATATTA
TTGACAAGTATTTTTTTTCTTTTTCTTTTTTTGTTGGGGGGGGGCTATCAAATTTTAGGTGCGGAAGATAAGGAAACTACGATCTA
AAATGGTGAAAGGTCTCAGTTAATAGGACAGTTAGGTGTTCTTTTTTCTGCCTTTTTTTTATTTTTTTATTTTTTTCTGGATTAGTT
AGAATGGGATTTTATAGGTGTGAAGACTTTGGCCTGGTTCTCTTGTCTTAAAGTACTATTTCTTCATGTTGAAGCTGGTAAAGGGTA
GTTGGTGATGAAAGATATATGATTTAAGCTGGGTTAGTTAAGAGTACTATTGAATTTGGGAATATTATTTGGATTAGTTCAGAGTAC
TCTTTGCTTTCAACTTATGGTTTTTTTTGTTGTATAACGGAAGTTGTTTTCTTAATGCAATAAGAAAGATGATGAAAGTGTTAAAGA
GGAGTATGTTATTGAAATTCCTTCTTTTTAAAAAAATGTTTCACATATATGTATTATATTTCTTCTTTCTTACTTTGTTTACCCCTA
CTAGCAGTAGATGACTTCTTTTGAACTTCATATATTTTCTGTAATTAATAAAGCAGATTTTCTGGAATATGAGAAGGAGATACACTA
GAAATTGAGCATCCAGAGATTCAAGTAATATTGATATGTGCAAATAGAAAGAGAGATTACATAAGTATTTATACTTACGTTTAGCGT
TAGAATAAATATGTTAAACAGCCATATATTATTGGATAAACTTGACTTAAAATATTACAGTTTAAGGGGGGAAAACATCTCACCCAC
TCATCATATATATTCTATCTTTTTTTTTAACTGAAAAACAGGGTGAGAGGTCCTGATGTAGACGGTAGGGAGCGAACCTTGTCGTCA
CCATCCAGGCTACATCTGCCTTGTTTCCATCCTTCCAGGGCTCAGGCTATAGAAGAGTGTGCTGATAAACTTAAGACAACACAAATA
ATTACAATACACTATACTAGATACTTCAAAAGGATAGCGAGTGAATCCTGCTTAGAAGTTGTCCGTTGCTATGTTTCCCGCCCCTTC
TTTAGCTAGCTCCTTTAGACCGAGATCAATGGCAGCCTTGTGAAGAGAGGCGGCCCTTCTACTACTAGATGCTCCTGTCTAGAACAA
GGTAAAACGAGCAACATTAGAGGTATATATTGTGAGGTGAAATATGGACATCGTTGATATGAGGTTGTTTCTACTATTCTAAATCCA
CCACCAGCAGCAAGGGAGGAGAACCCTCCAGAGGGCTCTAAGCTTCAAATTAGCCAAGAGGTTGGGCTTGGCAGAGATAAGATGGTC
CACTTCTTGAGGCCAGTTCCCAATCTGCTCGTATGGGATGAGGACTACCCAAACATTTCTAGTGAAAGAGCAGTTATTAAAGAGATG
GTTATGAGATTCAGTTTTAGTGCTGCACAGAGAGCATATGGGGTCTCCTGTCCATTCTTTCTTAGATAGGTTATCCTTAGTATTAAG
TTTATGATGACTCAAAATCCAAAAAACCCTTAACTTTGAGAGGGACAGGAGATTTCCAGATAAAATTTGAAAGATGGTAGGTGGTAC
CTCTAAAGTTGAGAATATTGTAGAAGGACTTGACTGAGAACTCGTCTGATGAGAGATGAGGCCATGTTATACCATCTTGGACTAATA
CATCTGGTGGCTTGGTTGACTCAAGGAGAAGGTAGAGCTTGGTGATATCAGATCTCTCCTCTGCTGTGAATCCTCTTCTGAGAATTG
GGTGCCATTTCCAGGTGTTATGGATGAATAAACCTTGAGAATATGTAGAAGTGTTGTGGGAGAATGCTAATTTGAACACTCTAGGGA
AGAGACTGGAGAGTGTTGTCCCCCAACCATTTGTCCTGCCAAAATCTGCAGGTGTAACCAGCTCCGAGAGTCCAGCGGACCTGGAAA
GGGTCTTGAATTAAGTATAAGTCTTTAATCAGATTAGATGTTGAAACTTTTAGGGGATTAGATACAGGGTTGGAGTCGTTTACAGAG
TAAATGGAGAAGATGACTTTGCTGATATAAGACTTATTGTCAAGGATTTTCCAAATCCATTTAGAAAGCAGAGCAAGGTTGAATGGT
TGCAAGTTAATGACACCTAAACCTCCTTCACTCTTAGCTTTACAAACTCTACCCCAGTTGACCAGACATTTAGGTTTAGAGGACTGC
TTGTAGTCACCCCAAAGGAAATTTCTTCTGATTTTATCAATAGCTTTGATGAGCAAACTTGGAAGTTTAAAAAATGACATGTAATAT
AAAGGGAGAGAGGATATAACAAAGTTTATGAGAGTAAGTCCTCCACCAATAGACAGAGACTTGTTTTTCCACAAAGCTAACTTCTTA
GAGAAGGAATCTAGAAGGGGTTGCCACTCCCGTCTAGTGAGGGTACCTTTTTTGAGAGGAAGACCAAGGTATGAGAAGGGAGGGAGC
CAATAAAACAGTTAAGCTTGTTTGCCAGATGAATTCCCCTACTAGGGACTATGCCCAGGTAGTATAGACATGACTTGTAGTGATTAA
CATTGAGACCTGAGATGTTGCCAAAAATGAACAAGATAGTTTTAAGGGTAATGATGTCATTATGATATGCTTTACAAAAAATGAGAG
TGTCGTCTACAAATTGAAGGGTTCTTATAGAATTTAGCTCTCTTTTAAGGTTAAGATCAAAAAGGTCTCCTGCCTGAATACTAGTAG
ATATCATCTTGTTTAGGACATCCACAATCAACAGGAAGAGCAAAGGAGAGAGGGGGTCACCCTGTTTTAGACCTCGATGCCATTTGA
AATGGGTGGTTGGAGAACCATTTACAAGGACTACAGATTTAGCTGAAGAGAGGATGTGGGATATCCAGAGGCACCACCTGGGATTAA
AACCTCTGGCTTTAAGAAGGGAGAGAAGGAAGTCCTAATGAACACAGTCAAAAGCTCTGAAAAAATCCACTTTTATCGTACACAGTT
CTTTTTTGCCAGAAGAGCGACAGTTGATCATCTCATGAGCCAGAAGGATTAAGTCAAGAGAAGATTTGCACTTTGAAAAGCAGACTG
AGATTTGTCTACCAAAGATGGAATGAGAGGCTTGAGCTGGTTGGCTAAGCTTTTGGTGAAGATCTTGACTGAACTATTGATAAGGCT
CATGGGTCTGAATTCAGCTGGAGAGCTGGCCCCTTCCTTCTTAGGAATGAGACAGATAAAAAAGTAGTTGATGTTATGAAGAGGTTT
TGTATCAAGAGTGTAATGACTGGATAAAGGATATACCATCTTGATAAATGACATGCCATTTTTCTGAAAAAATGAATAGGGAGACCA

Fig. 13U

TCAGGCCCTGGGGATTTGTCTGGGTGTAGTTCAAAAACTGCATGCTTGATTTTGTCTACTGAGGAGGATGAGTCCAAGGTAGAAAGG
TCTACAGGAGAGGGAGGATAAAGATGATTCCAATTGATACTGAATCTGGAGGCTGGTTGAGCTTGGAAAAGATTAGAGAAATAGTCA
TAGAATGCCTGTGTTATTGACATCTGACTCAGAGGAGAGAATAGTGTTATTGATGGAAAGGTAGGGAATGAAGTTGATCCTCCTATG
GTGAGAAGCAATTCTGTGGAAAAAAGTTGTATTGTTATCTCCTTCTTTAAGCCATTGGATCCTAGTTCTCTATTTCCATTTAATCTC
TTCAGCTTTGCCCAGAGAAAAATGGACCTCTCTAAGGTTAACTCTGTATTCGAGTTCATAATCAGAAAGGGGTCTAGATTCTTCTAA
ACAGTTGAGATGATCAAGATCATTTAGGCCCTTGGATGCAAGCTGAGAGTTGGATTGAAGAACGTGTCTTTTTCACCATTTGATCCT
CCTCCTGATGAGTTTGATTTTAAGAGGGAGGGAGGCTGAATGGTCATTGTGGGATGAGAAGGAGATCCAACACGACTGAATAAAAGG
AAAGAAAGAGGGAATGGTAAACCATGATTTTTCCAATCTGAACACTGGCCAAGGACTGAGACCACCAGAATATAGAATAATAGGAAA
GTGATCCGAGCAGGGAGATTAATAAGCAAACTAAACCAGAAATGGGAAATGGGACTCAAAATCATGGGATATGAGAAATCTGTCAAG
CCTAGCTAGAACTGGATTGGCTCTTTGGTTAGACCAAGTGAACTTTCTACCACTGAGAGGAAGATCATGGAGTTGGAAGGAGTCAAT
GAGATAATTGAAGGAGTTGATATCTCTAATGGAGCCAGTCTACCACTTCTCTCATCTAAACTTAAAGTCAAATTAAAATCTCCAAAA
ACTACCTAAGCCAATGACGTGGATTGCTTAATCCTGGATAATTCCCACCAGTAGACCTCTCTATCGTCTTTATCGTGAGGAGCATAA
ACAATAGTGGCAGCAAATTTCCAATTTGAAGGTTTGTGGATCAGGAAGACAGTAACTGAGAATATACCAATAGACGATGATGTACAG
GAAAATAATGACTCTTTCCAACCCATCAGAATACCCCCTAGATTCCGTGGCATCTAAAACCGACCAAGAGAATATACTGCTACTCCC
CAAACTATTGAGGTTCTCGGAGAGATGGAAGAAAGTTGTGTTTCTTGAAGACTCACTAGGTTTATATTTGCTGACTGAATACAGAC
TTTCACTAATCTACATTTAGTAGGATTATTTAACCCTCTCACATTCCATGAACCAAGCTTCATTACTTGATATGCAAGACAACTTAA
TGCTAGAAACCATCACAATTAGGTGGGGTTGGTCCCGACTTTTTCCATAGCTTGAAGATCTGAAAGTCCTAGGGGATCAACTGGCTC
TTGGATGCCGCAATTAATAGCAATGTCACGGAGTTTGTCTATGCAGATTGAAGAAATAGGCATAGATGGGGTTAGAGATTTACCTTT
ATTTCCACCTGGGGGGGACTCCTTTTCATGAACGCTATGTGCTTTCTGTGAGGCAGGTGAGCGAGCATCCTTTTTGAGGACTTCCTT
TTGGACAGTTTCTTAACATGCTCGAAGCCTGAAGGAGGGTCTGATGATGAGACGACATCCATGGATTCTGATGAGTTGTTGATGTTA
ACGGGAGGGATTTGGTTGTTGGAGAGCAGAGGAACTGTTGAAGCTGCGGGCTGATGACGGAAAGGCTAAAGACAGCAGTTCCCAGGAG
TCTTTTGCAATCTTGATAGGGACCCCCTTGAAGACGACCTCAATGAACTTAGCTGGGGCTACTTCACCTAGAGAGGTCCCCTCCCCC
CCGACATCCATGACATTTTTCCCTTTGTGGTCAATATGGATGCGGACTGATTCTATATTCTAGTTGGTGGTTGCTGCTGCTGCTTGC
TTTGCTTTTGTCGATGATGGGTTGAGGGAGGGAGGAACTTTTGATGAGGATGATGGTTCTCCTTCTTTCCTAATAAAATGCTCAAAA
TACTCAAGACATTACCTTTCTTTTCCGGCAGTGGTTTTCCCACTCCCTAAGCTGAACAGATCACTCCATAGTGTGACTATCATCTAG
GGAAGAATATCGAAAGATAACAGATCTTGGGATCTCAGCAGTGTCCCGAACACTAAGCATAGCTTTACGCTCTCTGGTATTAGATTT
GATCATGACATCGTCTGAGACAGTGATAACGTCTCCAATATCCCCTAACAACTGCATGTTAAAATCTGAATCCCATAAGTGAAGAGG
GAGACCTAGAGTCTCAACCCAGACATACATAAATTTTGGAAGAACTTTTAAGGCCCCTTTGCTCAGCCCACGGGGTAAAGACTCCTC
CAAAAGTACCCATATCGAAGAACTCCTTGGAGCAGGCCATGGCTAGGGTTTCGTCGTTGGGAAACTGAATGAAGAAAGCCGAGGGGG
AGGAACACTTGATCTTGTATGTCCATCTATCCACTTTGAGGTGGTACTCCAGATTCTCATTGAGTTCCGAAAGAAGAAGGGTTGCCC
ACTTGGAGTTCAAAAAAACCATAACTAGAATACTCCTTCATGTTGTTGATGACTGAGGGTGGCAGCTCGATGTTTGGGATGAACAGA
GGAAGGGGAGAAGGAGCGGAGGGGATGATGTTATAGAGAGGAGGGTTGTTCTTGCTAGGACAATAGATCGAAGTGTGCACAACTCTA
TTGCCAGCAAAGCATTTGAAATCTCCCAAGGTGCAGTTCCTAGCTATATGGAATTTGTCACCACAGAAAAAACACCTAGAAGGTTTA
GGCTTAGGGGGAGCAGAGAGGGGGGTTGGGATGCTTGGGTCTCTTTTTGTTGGACACTGTCTTCCAGCCTCCTTCATGGAGGGGGGG
GATACCCTTTTGGGAGGAGGGAGGGGTGGACAGAGAGAGGAGGATGAGTTAATACCCTTAAAGAGGTCTGTGAAAGAGGAGTAAAGT
GGCGGAGAAGAGGGAAGTTGCTAAGGTTTGGGACTGATGGAAGGAGGAGGAGGACGGAAGGAGAAAACTGTGGGTGGTTGGGAAGGC
GGAGGGCCTGTTTTGGGTGGCACTGTGGGTGGATTGATGGAAAGCAAAGGAGTAATTGTGATGTTACTATTGTTGATAGAGACTAAT
CGCCGCCTGGATGAACGTGCTGCCATGCACCTTTTCGCCTCTTCGATCGCCTTTTCGCTTCCATCTCGCGAAAAAGGTTTTCTTGAT
CTGGTGAACTTTATACTTTGAATTTGGAATTTCAGTAATTGAATCCAATTCTATCATACGAGCATCTACCTGGGATTTGAAAAATTC
ATTATCATAAAAATTGAGAATCATAAATTTCATAAAACATGAGAATCATTAATTTCATCCAAAAGATGGTATTTATCATAAAATTCA
TGGTAGTATGAAATAAAAGTAGTTAATTTTATTTTAGTTGATTCTCATGAACGATATTCTGAAGTCATGTATCACTTTGGTGAAGAT
TAAACTTTTATGACTTTTTTTTCTCTATTACAAATGTTAGTTCATTTTTTTTCTGCAAAGCCCCCAACAGTTCATGATATAGTTTTGT
TATCATTACACTGGATATTATCTCTGATTTTACAAATCTGTGGTTGTGTTTGCTTAATTAATTAGATTGTATCAAGACACATTGAGC
TATTATCAGAGCAGCAACTCTTGGGAATCTGCAGTCTGCAGCACTCAGCACAGGAGACAGAAGAAGCACTGAGCCAAGGGCTTGCAA
CCCTTAACCGGTCATTGACGGAGACTGTCGTCTCCGATGCTCTGAGCTTCTCCTCCGACATTGCCGGCTACATGGGTCAGATGTACT
CGGTTGCCATCAACAAGCTCAACAACCTTGAAGCTTTTGTTATACAAGTAAGAATTACTATATATCCAATACTACACACAATTAATA
CATAAACTGTAAGTTTCATAGGCAGTAACTATGTATCATGTACTATTCAGGGTTCTGCGTAAAATATCATAAACTATTTTGTTGCAA
ACATACCAAAAGTTTCTACATTAGCATAAAATGTCACTAAGGATGGTTTTATGATAGTACCTGAGATCTAGTCCTTGATAATTATAT
AACAGTAGTGTAAAGTCCCTGATATATAGTTAACAACTTTATCCAAAAGTTATTGACGTGGCTTTATAAAATATAAATAAAAATTCA
TGATATTTAGTTCATGAATAATTTTTTTTTACAGTATAATACGCCAGTCAAGCGTCGTATCGACACACAAGCCTGTGATTACTCGTT
TTAATTATAATCCTGTACTTTTCTTTCTCCCCTGCTGAGCGTTTACGTGCCAAAAAAGGGGAAAAAATTAAGAAATTTCAATTGCAA
ATTTGCAGGCAGACAACCTGAGGCAGCACACAATCCACAGGCTTCACCAGATACTAAGTGGTAGACAAGCTGCGTTGTGCTTCTTGG
CGATGGAAGACTACTTTCATCGTCTTCGAGCCCTCAGCTCACTGTGGATGGCTCGTCCAAGAAACTTTTAGACGTCGAAAAGATTTG
TAGAGAGATGTACAGATGCTGTCAGTTCTTTCTTGAGGAAATTTTGTAGATTAGAAACCAATGACAGTTACAGAAGAAAATACTGAA
TACATTTTTGCTGATTGCATGTTACTTTAAAGGGAATTAAGGTCATAGACGATCCCTTGAAGAAAATCATATAAGAGGAAGGATAAA
TAACGTGTAGACTTTAAAATCGATGATTATCGCATCGATACGATTGTCTGTTTTATTGATTCGTAGGGAACTTATTTCGATCTTACT
TCTTACATCATTTGTTGCATCAAACACAATAAGCGAAAGAAGAAAAAAAGAAGAAAAAAGACATTTCATCAGAAGGACAACTGTCTT
CACTTGAATACAGTGGTTGGCAGCGATAATCGTTTAACTGCAGTTCAATTAGTACAGCCAATAATGTGCTGATTTAGTAATTATAAT
ATATGGGTTAAACTTCATGGAATGTCATGTATCATTCTCTCTTTTCTTCCCATACAGTATTTTCCTTTATTGCCTAATCAAAGAAAG
AGCAACCCACCGCAAAAATCACAATACAAAGACAAATCTTCCATTTTTGTCAGCACCAAAGTGAATGAAGAGAAGAAAAAAAATTTT

Fig. 13V

GTAACTTCAACAATTTTCAGCTACATTTCTGGATTCTCCAACAGAAAAAGTGCTGAGATGAACTCTACCCATCTATTACATGCTGAA
CACCCTCCCTGCCATGCTTTTAAATTCGGTATACAGAGTAAAACAGGCACAAAACAACTGTGGCCTGCAAAGAGAAAATGTAACAAA
ATTAAATCAAAAAAAAGTTGTCAAGCGGCCACTTATTAATTATACCATCTGGGATCTGAGGTCCCCAGCAACAGAACTCCCAGCTGT
GAATCGTAACATATTAAGCACTTTCAAAATGTGGCGTGTGATCATGTTTTCTAAAATGCTTCTGATTGTTCATGCTGCATTCTTCGC
CTTTTGTTTCTGCTTCTTGGAATCAAGAGAAGCCAACCCACCGCCCAAGCCTGCAGGAGTTTGGCTGTCAGCCGATCTATTTGTGTC
CTTGTCACCAATAACAGCACCATTTGGCGTGGGGTTGTCACTAGGATCCTTCGTTTCAGATGAGTGGGCAGTTTCTGTAGCTGTTGA
AGTATTGTTGATGATGTTGAGGAGTTGAGCGAGTGGTAGAGGTTGGACGGGAGCAATATTCTGGCTAACAAGGAGACCTCTCGCTGC
TGCTTTCTTTCGAGCTTCAGCAGCAGCCCTAGCGGNNNNNNNNNNNNNNNNNNNNNNNNNNNNNNNNNNGCTTGTAATGCTTGTATT
AGATTGGGATGAGCCTGTTAAAAGAATGGAAAGGGAAAAAAAAAGTTAAGAGCATAGGACCTCTTATACACCCAAGTACACAAACAG
GGTATGGAGGGCCAATGAACAAAGGACAGAACTTCCTCACATGGCACACTAAAACTCAAATATCTGCATGTAATTGTTTCATGATCT
AACCAATAACTATAAAGTTACAAAATCTAATTATAATTTTCCCATCAGTTTCTCAGTCCACAAAATTATTGGCTCTACATGATTTAG
CAACTCTCCAACCCATGGCAGCATCATCCATATTAATCTCAATGTAGTAACATCACATAACCTAGACCAGCCTTGTCACTCACGATT
TAAATCTAAATCAAAATCCCAATAACTAGATTATTCTTCTAACTTTTTGTTGCCTCACACCACTGGTCTTCACCTCTCTGGCCAGGC
TAATAGTATTCCTTATTTATATGCTATATCTTTACAAAGTTTTGTGTGTGCACATGCGTGTTTGTTATATACAAGCATCCAGCTCTC
TTTCTGTACTTGCGGTGAGTTACGGTGAGTTCTCAAAATTAGTTTTTTGATTAATTAAGAATGTACAAATTTAGTTGACATCATGAG
TTACAGTAAGCTCTCTGCTACACCCTTTTTTCCTCACATACGTTGTTAAAAAAAATTTCTTCGTACTTCAAGCATGTATTGTATCAT
GCACATATCATGTGCACCAGAACACTAGTATATCATGAAAAAACAGAACATAAAAGAATGTACCTTCAGAATATCAATAGCCTTTTG
GGCAGAAGCCGAATCCAACTCCTGACCTTTCTGTTTCTGTGCTTTAACCTGCCATGGAAATAACACATTGAATCATAAAAAGAGTAA
GGTAAAAAAAAACAATTTGAATGCTGCAGGTAATCCTGAGCATTTGAAGCTTTGAACATTAACTTTCATTTCTATTGAAGTGGCTGA
TATATGCATTTAGTCAGATCATCAGATACAGAATTCCTAGGACCAACTAAAATCTCAGGAAATAGAGCATTTACATAGAAATGTAGT
ATTATTTTAGAAAGTAAAATTGCAATTACTGATTAGTACTGTACCAAATTCATACAATATACACAAAAATCAGTTTCATGGCAGGTT
TTGGAAGATAACCTGTAAAATTTGTGGAAACTGCTGTTTCAGTTTAACAATAACTGAAACTTCATTTAAACCCTGTTCCGTGAGTAC
AGGTTAAACCTGGCAATAATTATGTAAAAATATCATTAAAACATTCTCCAGTAATTTAGCTATCTTAGATCAAATTCTCAACATTCT
CATAATATTAAGCATGTTTCCAGCATACTCATTAATTTTCCAGTGATTCATTCTCCTTAGTCACCTTCCAACAAAATACATTTTCTC
ATAAGTTGTATAGATTCCCAACAAACTTTTCTCTAGAATTCCAATTGATAAAACATATTTTCATTTCCATTCACACTTTTCAAAATT
ATGTTTCTTCCACAAGTAAACCACATTATATTTGCATGGTTCCTTACGAAAGAAGCAAAACACTATAAGTTAGAGACTTCAACATGC
TGACAATATAAGAAATGCTAGTTACCTGCAGTTCACGCATCTTAAATGTCTTCATCCAATTCTCTGACTCTCGCGTCCGTGAATCCT
CGTCCCCGAGTTGTTTAGAAAGTATATCATAGTTTTTTTTCTCATGCTGTAATAAGAAACAAGAAATTCTTACAACATAATACAACC
AACAACAAAGGCCAATAGCCGTGTACTTGGAGTGACATGCCTGAAGAGAGAGCTTGTAGGCTCCCATACAGTTGAATGCAATTGCAA
GAGCATGGTAACAAACTGCGGTTTGAATATGTTCTGGACCAAGAAGCCTCTCGTTCTTCTTTAAGGCTTCCTGCAAGTACCTCAGTG
CAGCATCCATTTTCCCAAGATCCTGATACATAATTGCAATGTTTATATAAGTTGCTGCAACATCAGGATGGTCAGGGCCTGTTGATA
GGCTCAACAACAACAGTGTTCTGGACATGTGACGTAAAGCCAGCTCTGTTTGAGTGAGCCCGTGATAGAAGAGACCCATGTTTCCAT
AACTGAAAGCAACATAACAATGGAGCAACTTGGTAAAAGATAAAGAGATTCAAACAATAGAACCACCAAAAACACCAAGGATAAGAC
AAAACCTGTGGGCTGTATCAGGGTGATCAAGGCCAAGGCAATGCTCATTGATGATTAGCTCTTTATGCTGCTGCATAATGGCTCCAG
CCAGGTCGCCTGCATGATATAAAACCATGGCAAGATACCTGAAATTTCAGATGTGTACACCGTCAATGAAAGTGTGAACCTTTGTCA
TAGACAAGTAAATCTTTATCTTCTGCACACAACTGAGAGGAGGGAAAATCTGACAGTATCAGTTTTCTAACAGATGACCACATGCAG
ATTAGAAATAGAGAATAGATCAAGTGCTGAAAACACATAGCATACTTCCTAAGGCGAAAAGTTGGCGACATTCTGGATTAATGCAGA
TCAAAATTTTGGATATTCCTCCAGAACTTTATGTATGCCTTGCAATCATCAAGATAAAGAAATATAACAGGCCAAAGCAGACTAAAG
AGCAGAAATTCTAAAAAAAATCTTGGCCACAATGTCAGATGGCCAGCCTAAGTAGTAGCATATAGGGCCTTATAGAACATAACCCTC
AATACCAAGTTTCTCCCTAATCATAGCCAGCTCTAGCAAAAACAATATTAAACGCCCAATTTCACTATTTCAGCAGTTCATTTAGAA
CTGCCTCTATATATGATATTAGTAGCAATAATTTCAAATAATAGAGTAAGCTAAAAGTAAAAATAGGAAAGACGTGGAATAGGCTGT
TTTTCCTTTTCTTAAGTACTTTATGTTCAATCACTAAAACTCTAATATTACATGGAGTTATATACCAAACATTGTAAACATATATAA
AATATCACACAAGTAATTACCGGCAACAATTAGCAACCTCTCTGTGCATCGGACCTGTGACCTGTATCAATTGGCTTCCAACTTTTA
GAAACATCAATGCTGAAATGCTGAGGTACTACAGAATGTAGACAGGAACAGACAAAAAATAGCTTACTTGTTGAAGTATGGAAAATG
CTTCAGAAAAAAGAGTGTAGGCTTCATTTAATAATCCCTATAAAACAGGAAACATTTTAAACCATAACATTCATAACTGGATATGGA
GCACAGTGCAAAATGAACATAAATGAACACTTTCAGAAGACTGATTAGTTCCAAAATTTTATATGACGCATAATTTGCAATGGAAAT
GGTATGCTAACTGCTAAGATACCTCAGCAAGCCGATTTTTCCCTGCTGCCATTATATCCCTTGCTTCTGAACAAAACGGAACTGAAT
GTTTAACAACTGGCATGAGGTCTAGAACATCTGAACTTTGAAAGGGTGATGCAGAACCAAGATCATATTTCCGTGATGCAATTTTTA
TGCCTACCTGTTAGAATTCACGAAAATTGAGAATAGATAATATTTAAAATGTCAATCTGAACTAATCAAACATGATTATACTCATCA
GATATAGCAAAAAAAGCAATTACATTTAAGACCAATAATGATCCTAAACCAGCTCAAAGAATCAAGCACGGAGTAGGTGAGCCAAAA
AAAGATGATTTACTGTGTGAAACTAAACTTGGATAAGATCATATTTGATATCTTCGGCATTGTGCACTAGGACAGTAAGATTCTATT
TGATATCTTCAGCACCATGCACTAGGAAAAAGGTGTACCTTTTGGCAAAGATTTCGGATAACTGAAACCTTCTTTACTCTTGACTTT
GCATCCTCTGGTAATTCAAACTACATTTGATAAGAAGAAATTTAGACAATTTTATATATGGAAGTATATTAATAGAGGATGCCCAGG
GGCTCAATCCTGGTTCACACTACCTGATACTTAGATTTTGCAAATTCCTGAATGCATGACCAGAGTCCTTCAGAAGTCAAAGACATG
TATGCGGATTGACTTGTCCTAGAAACTGTCCCATAACTCCACTTTGTTTGCCTTTTACCTGATTTGCGTGCAGACTGGACATCTGAG
TGGTCCTGGAAATCAAAATCAAGTATCAAGTGATCTGCAGGTTAAACTTTAGAAGAGAGAATCAGGGAGGCAGCAAATGAGAGGAAG
GATACACATGTTCCATGCAGAGTGTTTAACAGACAAGTAATAATCATCAAAGTAGAAATGGTGGTATGATCATGCCATAGATTATTA
ACCATTTGTTATGTGGCAACTACCCATCCCCCAGGCAAGGGCAATGCCATTCAGTTTTAAACTTATGAAAGTGGGAGCCAGCCTCCA
AGAACCTTGATACTAGTAATAAAAAATGGCATGTTATACGTAGTGTGGAGGGATAGACGAAGGGACAGAGGGGCAGAGAGATGCAAG
GCGGTTAAAATATTTAACAAAGATTTCACAGTTTATGTTAGCATAATAATGAACCTCTACTGTAGTTGGCATTCAAGTACTGGAAAT

Fig. 13W

CAAGTGTACACCTATGGGTTATGTCACTCTTACTTGAGGTACTTATGCTATCAGATTGAAGTATCAATAAGCATGCATATGATGGAA
GAACAAGTATCCCAAACTATGAAAAGTTTCACTAGCATGCACGGATACAAGAAAACATATAGAGATGCATTGACATGAAGACCTAGA
AGCTGAATGTTGAAAGATGCAGGTTTTGCAAATTTCAAGTACCTTTTGAGGCTTTGTTTGCATACAGTCAGTAGCACCTTTCTCAGA
AGGAGTCAATATAAGTCCAAAAAAACAATTGAAGAAATGTGAGATAGCTGGTGCAAGATCATGGTCCTGGCAGTCCCTAAGAGTATC
CTGGCCAAAAATGAAAGAATTTCATATTAAGATGATAACTCCATGAGTTTATTATAATGGTATATCATAGTTATAACTGTCTTACAA
GAAATACTCGTTAAGGCTATTACATCTCAATATATCAAGTTCATCCACTAGGGATTAAATTCTTGAAACAGAATTTCCACAGAAGAT
AACGAACATATAAAGGCGGATCTAGATTTTAACCAAGGTAGGGCACGTGCCCCCTTTCATAGTTGTCAATTATACATTATATCTAAT
AAAAGAGCATATTCTCAATCTAAAAAGTAAATCCTAGTTATCTTCCAGTTCACATGTTTTCAATCTTGCCCTTTCTTTTTCTGGTAA
TCTTGCATCTTCCTTTAATATTACCCACTAAATATGTTATCAGGTTAAGAAGCAATATTAGTTTTGAACTTCTATCAAGTAATAAAC
TTAAAAATCAATACTTTGTTGTCTAGACATTTCAAATGGTTCAGACCATCTTATAATTTTTTTTTTTTGTTTCTTTTGTTTCTTTTTT
TTTTTTTTTTTTTTTTTTTTNNNNNNNNNNGATTGATACCAAGCTAATATCCTCAAGAAATCAACCTTCAGTCTAATTAGAAGCAGAA
TTACCGAAACGAAGAGAAATTCATACTAAATGATATTTGGAAAAACGTGCTCACCTTAAGTATATGTTTTGTTGACCTAACGATGAC
CTCAGTAGTACATAAATCCCATAAATGTGCCAGATGTTTGGTCATATTAGCTACCTGAGGAACAAAAAAATAATGCAAGCTATCAGCA
AAAATAGAAGAATTTAGGGGAAACTCAAGACAAACAAGAGCTTGTAACCTTTCCGAGGTAGCGAACATTTATCCCCTGGGCATGGAG
CGTATCAGTCAATGTTTGGCCATCCATCGGTGAAACCTCAAGGGCACAAAGATCTTGGACAAATTTTGGAAGAACAACATCCAGAAG
GTATGAACTGGCTTTTCTCACATTTGCTTCATCTGCTGAATTTTCCTGTAAGAGAAGAGGAAATTTTGAGGATTATAAAAAGTGGAG
ATCATGAAGTGGAGATTATGAAAACAGAGAAAGAAAAGGCAAAATGAAAAACCAACAATTAGGGATTTTACCTCTTCGCTTCCTCCT
AGTTTAAAGTCTGTAAATACATTGGGATTCAAAAGTATTTCTGCACAGGATTTGCAACTGCTATCTGCAGCAGATGTGCATCCTTCA
CTACTCTCTTTATGCACATCTGTTGGTGTTTCCTACAGAAAGAAAATAAGCTTATTTGACACAATCTCTGTCACAATAATCTAAAGT
GTTTTACCATCAGAATGGAGTTGGCTCAGGAGCACAGGGCACCATGAGACTTGTGACAATATTTTATGTCCACGTGACATCAATATT
TAGTTTGATGCCAGAGTCATTGTCAAGGAAATTATGCACGTTCAACCTCACACAAAAAGAGGAAGAGGGGTCGNNNNNNNNNNCAAA
TTTCATGTACACTAAGAAAGATCTAGAAGAAAAGGAATGATAATACATTTGCTTATGCTTAACTTCGAGTTGCTCGTGAACTCAAAG
AAACAAATAAAACACACTCTCAGTGGAGAACTCAAACCAAATATCTCAAAACTGAATTATTTCAAAATTTCAGAACTCACCGTTGCA
TCAGCTACACTATTTTTAGAATCCGATGCTATTGGAACTACTTCGGTTTTAGCTTGTGACCGTGACACCTCTGTAGCTTCATCCTTG
CTCACATTAAGATAGAGGATAATCAGGAAGAGAAACAAGAATTATCATTAAAATACTCTAGATGAGGGGGAAATATAGGAATACCT
GGCAAAACATAGTGACAAGCTCAGGCCTCAAAACACAAAATCGAGAGCTGGGACCAGTGTAATTTGAATCGCGAGGGGTTACCCTCA
TTAAATCCAAAAGATANNNNNNNNNNAGGAATTATAAAAGGAATTAAGAATAAGAATCTTTTAAATAAGCTGATAACACAGTTGCTG
TAAGGACATGCATATAAGCTGCATAAAATGTAATGAAATATTGGAGAAGCAAGTCTGAAGAGCACCTAACTTTCCCCCTGTATTCTA
AAGAGCCCCTAAGTTTTCTTTTTCACAAAGCACTCCTCTACTTTCAATTCCAGTTTCTCATTACCGCATGGACATCTTTAGACGTTT
AAAACATGGGTATTTTGGTCTTTATTTTAATTTTTTAGCATTGAGCTTCAATTCCAGCATAAGCTTTGATCAGTTACTTGGTTTACT
TGACACTGTTGTTGGGGATAAATGTTCCCTGTAACTATCCCACCTTACAAGACAGAGAACAATCAGAAAAAGACTAAAATTGAAGTA
TTGGTAAATATAGTCGTATAGAGGTTAGGAGAGAATTGTTCATACAAAAACGCAATGCGCACATGACGCTCAACTCCCATTTCCCAC
AACCATAACAAAATTATAAGATCCATGTTTCTCTGTGTGAGAACTTAAACACATTTCAATATACAAGATCAAAGTTTGCCAAGAAGC
ACGAGAACTCAATTAACCAAGAAGCAAAAACCCTAATTTGGAGGGGGAAAAGCCTTAAATTTCAAATTGAGCTTCTTTGAGACATTT
ACCCTTGACTGTGTTAAAGAAAACAGCTTACTTTTAACTAAGGCACTAATGAAAAAACGGAATTGAAAGTTGAGGGCAGCTTGTAGA
AAATAAAAACTTAAGGCCTTCTTAGAACAGATGAGAAAATGTTAGGGGCTCTATAGACTTACCTCTCTGAAATATTGCACACACTAG
GAACCATGACGAGCATAATTTAACTCCTTCACTCTCCAATACACACAACAACAAGCACACACAGGCACTTGCTCATATAAATCTTTG
GAAGAGAAGCAAACAACTGTTACATATCACATCTGCATATGGAAAGAAGTTGATGTCCCAAGAAGTTGTGATATGCTGCTAACTTC
GCTAAACGAAAAGATGGAATCCAATGCTCCTGAACATGATTCTGAATGTACAAACAATTATTAACCTTTAAAAATGTAAAGAGGGCG
TGTTATGTCCTCTTTTCTTATACAAGCTAATCATTTTATAAATCATTGTGCTAAAACTAGGTTCTTTTGAATAAATAAAAAACAAGT
GACCAACCAATGTTTACACTTATATGCAGGGTGGACCTACATACGGTCCAAGAAGGCCTTGGCCCGCCCTTGAAGATTGAAAAAA
AATCAGCTGCATAGGTGGGTTTTGGGTTTAGAAGCTGAAGGCTGAGGAAGAACTTTAACAATTCATATTAGTCCCTCAAATCACTGA
AATTGTTTATTAGGCCCTCAAATGCATATTAGGTCTTACAAATTGGTCCCTCTAGTTATCTCACATTAGATCTGAGGGCATATTCT
CTCAAATCTAATGTCTTGAGGAGATGTTCCAATTTTACCTCTTGTTAAGGTTTTCAACTCATTTCTTAACTGCTATAAACCTTAAA
ATAAAATTTATGACCATTAAACTTATATTCTCCAACAATTAGAAAATGATTCCAACCAATTTGTGAGTTTCCCAAAGATTGTATTCC
CCCAAAATCTATATAATCTTAAAAAATTAAGGGACTAATATGGAATTACCGAAGAGGGACCAGTACTAAAAAATCTAGAAACAAGAA
TTTAAGCAAGATAGCAATTCTCTTGCTAATTTTTTCTCAATAGTTTCATAAACTGTGTTCATGCCTGAACCTATGAAAGTCACATCT
CCTTATATTGTGTTGTAAACCTATCTCTAATACAACTCATAATTTAAAACTAGAATTTAAAATTCAAATCATGATCTAAACCTACTA
CAATTGAAAATCCAAAATAACTCTATCCTAAAGAATGTGGATAACTCAATCTAATGAAATATCATATCTAAATCCTAAAAGATAAAG
TCGACTAACGTTCCCTCTCTCCTGCCCTGCTTTAATATGTTGTACTTATTTACTTTTTGCGCCTCCCTCCCCCTCTTCAATATTTCA
TGGCTCCGCCATTGCTTACATGGGTCCTATATGCTTAAACTAAGAAGAAATATACATAAATAGTTGTCTCCTCGTATCTGGATTTGG
ACCATTGCGATGTCTGCAGATCATATCTAAGAAGCAAGCAACTTTGTAATGTTCATTAAATGCATAGTGTTCCATTGAGATGAATAA
TCCTATATGTGCATTTGATAGGAATATGGTAAAATATCTATGATATATAAATTATAAAGATGATTTTGCCAATCATTTTAAGGGCAT
TTTATGCATGTTACAATGGTACATAAAACACATTATACCAAAATTATAGGTCTGTCTTATACTGTCGTGTGATCGCTAGAACTCCTA
ATACCTGAGCTTTAAACCCTCAAAATGCTTCTAGATGTCTCTAAGGCAGTGTTTAGCAACACCTCCACTAACCACGTAAGTGGAGCT
AACCTGGATAAGGCTTTGTTTTTTGTTTGGCTAAAATAGGGCCAACCCTAGACCAAGTATTGTTCAGTGTTGCCAATGCGCGACGCG
CGAGGCGCAATGCGGGGCGCAAAGTATCTTTATGCGCACATGCGCAAGGCGCAACGTAATGCAGGCGGCCTAGTAATGCGAGGCGCA
CATAGAACACATAATTTTTCAAGATAGATAATCAAACAAGAAAGAACATGTTTAGGAATTCACATAAAAAATATGTCGGGATAAACA
ATATCTTACTACAAAATCATAATATAAAGTCTTAATTTCTAATGCTAACACCCAACATAGTAGCAAAGTTCTTAATTTTTCAAAGGA
TTAGTTATGGTCCTTAATTGAAGGCTACTAAAAAGGCCTAATGGATTTATTTTACTTTTTGGGATATGGATTATCAAGTATAAAGAC

Fig. 13X

TCGATTGAAATGTTAACAAACAAAAATATATGAGGATATGTACTACATGCACCCTGCGCAAAGTTAGGATGTGCGCAAGGCGCAAAA
GGCGCTACTGCATCATATGTGGGGCGCTTTGCCACAGCCCCACATCGCAAGGTGCATGAGGCACAGTGCGGGGCGCACCTTTTAAAA
CATTGGGTTTTTTAGTTCATTGTTTGGCATTTATTCAAGTTAAAGTTAATTCACCACCTGTCTGGCTCAAAACTATCATGGTTAAGG
CTTTATCAGGTTAGTGAACAGTTGTCAAACACAGCCTAAGGTATGCAAATCATGTGATACAAAGCAAACCTAAATTGGTCCTTTCTT
CTACTTACCTTTTTCTCAAGTTGTTAAAAGTGACCCCGAACATTAACACAAAGCTGCCTGTGAAGAAATCTATCAATGTTCTAGAGG
GAGCTGAAATACTTCGATGGAGCCATCAAGGATCTAGTAATATCCTTTATGATGCTTTTGAACACTTGATACACAACCAGAAGGTAT
CCAGACAGCATGTTTTTTCATCCATTACGTTCTACTTTTACTATAAAGATCATGAAGCAACGAAAATGAAAGCTGGACAGCTTGGAC
ATGGGAATTATATTCACCCAAAGAAAGAATTGCCTCTTCTTTCCCTTGTACGTGTGTTTCCAAGAGTGAAAACACTTAGGCCATGAA
TATCATGATGAACAATATAGATCATTCATGATAGAAAAACATGTACAATTTTGGCAGCTACCTTGTGCAGAATTGCAGGCCAATTAC
TATAAACTTATATGGCAAAACTTAATAGAGCAGAAAACTTCCAATCAATAGCATCCTAACACCACTGTGCTCAATGAAACAAAGTGT
ACAAAGTGACATGCAAAGAGCATGCACCACACTTGTCTCTCATCACCTAGCAGAGATAACCACACTCCACACACCCTACGAAACACC
CACCCACGTGTGCTCTCTTTCGCGCATGGACTTTAATTATACAAGGCACATAACAGAGCTTTGAGAAGAATGAAAAATCACTCCTAA
CAAAGACTAATGAAGTCAGTGTCACCTGTCATCGCTGCCAACTATACCCTTGCATTCAACTGGAGCAGCTAGTTTGACAACATTGCC
CGAACCATCTAAAACAGTGTGTTCCTTCAAATGGAGACGTTTAGCAGCCTCTAATACCTATAACATGAAAAACAAAATAAGAATTGC
TGTGTGCAAAGAAAACATGAAATATAGTATCTACATTCTATAAACAATAATGATTGCAGGAAAATTATGCACCAAAAAACATCCGAT
TATGGATGCCATAATGAAATATAGCATGGAATTACTAGAAAAAGTAACAATGCATTGACTAAGCAGGGAAGACCGACAATGCTGATT
TTGCCCAAAACCTCAATGGTTTAACTACCATCTCTCAATTTCAATAGATCTTTCTCCTTAATTGTAATTATTTCTTCCACCGCATGT
TATTACCCATAAAAAATGGCAGGCAACTAACAACATTTCTGAATAGAAACTGAACATTGACAGTGGGCAACTCATAATAGCAGACAT
TAAACAAGCATCACACCTTAGAATGGAAGGATTCGCTCCAACAAATTTTCTTTGCATTGTCAACAGAACCATATAGAAGGGAGTCTG
ATTTATCACCTTGAAGGATGCCAGGTATAATGCTCTGCAGGGGAAAAAAATGAAGTAGAAGTAGAATAAAAAAAGCAAACAAAATTA
GAATTGGTTGGGACCAGAGAATCGACCCACTGCTAGAGATAACATTAGAACACTCAGCCCTAATTTAAAGAATTGAATAACATTAGA
AGATAGTTTTAATGTCAAACCTGTGCTACTACTCTATGACCTCGGTAATCCACAATTGCCATGGCAAGATTGTAAAGTCCAGGAACA
TCGGCTTCTTGGTAAGCTCTTGTTCCTTTTAAATCATTATTAGCAGAAGCATATGTAGCCTGCTCGCTGTCTGCAAGTTGTGCTTCA
GTAGCAGCAGAATCATCAGCAGCACAACTCTCAACTTCTGCTTTTGAGCTGTCGTAAGTACAAGCATTAGTTTCACCATTGGTTTCA
CATCCGGACCCATGATCTGAATTACTAGAGGCCTTCGCAGCTGAATTAGGCAAAGGTGTTGTACTTCCTTGCAGAACTGTGACTTTC
AAATCAGTGCTCGTTTGTCCTTTAGATATCAGGCCAAGGTCGGCATCCACAGCAAAGCTGAAGAATATGTTGTTGTGAACATACCTG
ATGCAGAACAAGTAAATTAGAAAAGCATAACATTTTCCAATTTCAACTTGATAATTGTAAACGGCAATGCACATGCCCATATATTAC
TGTATGCTAGAAAAGGAAGAACTAGAACATGGTAGAGTATATTATTAGCAAAGGACAAACATGTTCACTGGGCAGAAAATGCTCGAC
AAATACAATAAGGGAAGCTGATATAGCTCAGTGATGAAACCTTAGTATCTACTCAAGAACGGGCCACACTGTCATCCAGCTGCATTC
AAATGAAAGGCTAAAGAAGTACTAAAGGAAGACAGAAATATTAAAACTATTGGTAACGTTAATGTTCAAAATTGCAAATACTAACTG
GACAAAGGTCAAAAATTCTAATTGTGATAGGTACAAGAAATCATGCAATTAATGTATTCTCTAATGAACTGCTCTAAAAGAAAGAAA
CCTCTACATTCCAGTTGCAAAGAAAACTAGAGCATATAAAGACAAATTATGTAGATTTTCTAACGTATGAAACTCCATAAAAAGTGA
CTGCTAGGCATACTCACATATGGAAACACTCTGGATCTGTTGGATTAATTGGAGGAATGCATCTGTTTATAACCCCAATGGCACCCT
TAGATGCCGCATCAACAAAATCACAACTCACCTTATAAAGAGCACGATCACGCAAGATCCTGAAAGATGAAAACAAATTAATGGACA
ATAATTGCCGATTAGCTGTGCACACACTTCTAAATGAAATTAATTAACTGCCAAAAAAATAGACCCTAAACACAATCAACAAGCATA
AAACATGAGTAAAAGAAATGACATGTCATATAATACACCTTTCCTGAAGAGTTGTATGAGGAAACTCTCGACAAGACTGTAATTCCT
CGTTCCAGTCTCTCTGCATGCCAATGAGTTCATTTCCATAAGAAAGAGCAAGTGCATCCTCTGCTCTGGCTGCGTCTCGCTTATGAT
CTGCAGATGATCGTAATAATGCAGTTTACACAAGGATGTATAGGGAAATATTTAAACATAGGGTAAAATTAAAAAAATTAAAAGTGC
ACATCAAATCCCATCTAGAAATTCTGACTAAAAAAATCAGGAAACTAATTGCCAAAATCATTTATTATTCATACGGATCTGTTAAT
GAAGGACATCAGCTAAATCACATTAAAAGAAGCATCTTAGATCAAGTTACCAGAAAGTTGGAGGATAATAAGTTTATATAGTGGTGA
TAAGACAATCATACAATTCAATACTGCTCTCAAGACTGCATTTGCAGGTCCTTATTTTGAGTGTGGCTGCTCTTCCAGGTGCTTGTG
ATGACTAAGGTGAAGTTCTAAGGAGCTCGACCAAAGCAAGATAGAGAGAAACCTGGCACCTAAGCTGGACCCTTAGAAAACTTACAG
CATATTTTTAAGAATTTATCGTGCATGATATGCCCGATTATTTGCTAAGAGAAATCGTGGGCGTCGACGTAGAGCTTCTCATAGAAA
CAAAACAAAATGTATCACCTACTTACTACAAATTCAACCTAAAATTTAGTGTGGGCTACACAGGATCAACCAGCATAGCAGCACAGA
GTATGCCAGAAACCCCTGCATCAGGAAGTACCTCTGAGAATGACTTGTATGTGTCAGACTCAGTTAAGAGTGATGATAGGATCATAC
TTAATTGAATAACGAGAAAATGGTTGTGGACCAATTAAAGAGGTCATACCATGTAGGGCAAATCCCACTAGCATGCGTGCATTTCAA
AAATTTTGTGGATATGATGCAATTACGCACTTCTAAAGGACAGATTTAGTCAGTCGGAGACAATTGAATGTTAATTCATGCTTAAGC
TAGCACACTTGACATTAACATCACAGGATTAAGACTAAGTGATGGTTTTTGTGGGATACAAATAACTGAATAAGCAAGATTCGAAAA
AATAGTCTTGGCTATCATTATACACAGATCACATGCAAGTGCAGTTTATATTCAAGCAATTAGGACTAATGAGGTTTTTCATATTAG
AAATGTGATATAATTTCAGGCTTGAATAAAGGGCTCGTGATTAGGTGGTTAGACGTTGCTCCTATTGAGGATAAAGGGTGATAATTG
ATTGAGGTGGTTTGGCCATGTTCAATTAGGCCTTTAAACGCACCAACTTGAAGAAGTGATAAAATTATAATTAGTGGAGAAATGAGG
ACAAGAAGAAGGCTAAGAGAACTTGATTAGAAGCAATTACGAAGGACATGGCAAGATTCTCCAACCACATTAACTTAGGACGGAACTG
TGATAAGGAATAAAAGGGTGATGCATAGCAACAATGAAAAGGGCATTGTAGAAAACCTTTTTCCATCACTTTAGCAACAGATGCTTG
AGGATGAAAGCATATGGTTCTGAAAATGAATTTTTTTAGCATCTATATCAAAATTGCAGTTTCTTGCTTACCTGGGACAGGATATAT
ACCCAACCACAAATTCGGTGGCAACAAAGATTGAACATTTTCAAAAGGGTGAGCAGAAGCTTTCCGTTCCAAGATTTCACGAAAACC
TTCAAAATGTTTATCCAAAGTGTCAGACGCTGCTAATAACCAACTAGGTACAATATTTCTTTCCATCAGTAAATACTCCTGAATTTT
TCCTTACCTTTTTTGAACTTCATGCTGATCTTTTGGACTAGACCAATAAGGGTGGTTGCCTCAAAAGCAGACTTAAGAGGTTTGGGG
TTAAAAACTCCTGTGCTTGAGTTCACATAAAAACCTTTGGTCGTTCCGGTGATGCAATATTTGTTTCCTTCCAAGGTTGCAGCATCC
AGATAAATTAAATCTCCAACAAGCCTGAAAACGGATCAGGAAAAAGATAAGGTTTTGCAGCATATCGAAGATCATGATCATATATAA
ATGAAGATGGGAGCCGGACAAAGGAGTCCGTATGCCTTCAATCTGCAGACCAACTGCCTTAGTTGTATTGTAATAGTAATCATACTA

Fig. 13Y

TTTATCTCCAGTACGGTTGTTCAAGAAGATGTTGACCAATATTAAATGCAAGCACACATAAGCATGGAAACACTATATGAAGAGGAT
AAACATATCATTTTGTCATAATGACCAGTAGAAAGGCAGTGTGTTTTGCCAGATTGTGCTCAGAAGAGCTAACAATGCAGGTCAAGT
TCTGACATATTCAACAGACCAGAATCTGTATGAAATACAGCTGATGTTGGAATAAGTTTCAACGAAAGAAGAGCATCATACAAAGTA
GTTACCTCCTATAACTTGGAGGAGGATTAAATGAAGAGAATGTAATGCTCTCCACACAGTAGATGTCCTTAGGTGATGATGCAATCA
AATTGCAAAGAGAACCAGTTATATCTTCCATAAAACCCAAAACTTCAGGCTCGGAAGTTTCCACTTTTGCATCTGCGAGACAAGGAC
AAGTGCAATAAACATATTAACGTCTAAGTGAAAAGGCTTTCTGCTTAAAGAAAATAATAAGCATGCAAAATAATAGTGGTTTGTGTG
TGTATAGTAGAAAGCCAGACAACATGATTTTTATGACAGTGTGAAACAACATACTGAGTATGATACTTCCTATTGACTGCTCTAAGG
CCTGAAGAGAACATGCTGCAAACACACATGAAACCTCACAGTTCACCGTAAACATCAATGGCCCAATGTTAATTGTATTTTCACTTC
ATCTTCTCCCCTTAGATTTTTGGGCAGTCCATAACCTTAACGAAATAGGCCTAGGAGATGTGTTAACTAACTTTGGTTTTCATATAC
ACATGAATGCACACTGAGAATTTTGATGCCTATGCAGAAATTGGACTGGAAGAGTTGTCAGCTTCTTTTGGGAGTGAATAAGAGAAG
TGTATGTCTCCTACATGCACAGTTTTATATTTATATATGTATGTAGATATATGTACATGTAAATGTACAAGTATGCATGAATTGTTT
TATGCAAATTTATGATTGTATGCATGTCTCTGTAAAGTGTATGTTCATGGGCATGTATAACCCATCAAACTCATGGTTACAACATTG
ATAGATTTTAGTGATGGAATGAAAAAGATCATTTGAGGTACGGCAGAACTTAGAAGCAGTCAAAGTACGAGATTTTTTTTATGCACG
AATGATTTATTAAGAGAATACATCAAGATGAACATGATCCAGAGGAGGAGGAGGTGGGGGTTTACATCATCATCAGTGTGTGGAAGT
GGTTATGTATGTATTACTATGATTTTATATAATATATACGTTAAATCTAAGCTCATAACAGAAGAATCCAATCTCCTATAATTTTCT
AACAATTTAATTTTCTATTGAATGACTAGGAAACAAATAGAGGCATGATGTCATCCCAATAAAATGAAGATGAGATCATCTACATTG
TGTATCATTAGGTGTAAACTAAGCATCCAATAATTAAAAAGTCTAAGAAAGAGATCCTTTCTTCTCCTCACCCCCCACCCCCAACGT
GGAAGCGGTTAAAGTAGGAGATTTAGTATGAGCGTAGATGCATACATTTCATTAAGATAATAGATCAAGATGAAATGGATGATAGAG
GCATTCCCTCCCTCCCTCCCTCCCTCCCATATATACACACGCACACACATATATACAGATTTGTATATATGTACATATATGCACATA
AATTTATATATAAAATATAGAGCTAGCTAGCTAGGTAAATATGTTTATATGGTAAGTAGATAAAGATGTAACATATATCAGTGCATT
TCTGGAGAAAGGAGGCCAAAAACCTTGATTTTTTTGTTGCGCACTTTCATGTTGCAAGGCTAACGATGTTGATAATGAGACATGGAG
ATTGGAAAGAGACAGCAGTTCTCGTGCGCGACGGACATGAGACCTTATAGATCTATCATCATACAAAGCTGTGCAACCATTTATAAA
AGAAAATTACTGATCAAGTGCCAAGTACAAAATAAAATCAAGGCATAAGAAAAACAGATTATTAGGTTGATGTACCAGCAACCATCT
CTAAGGAGCAGCCACCAATAGTAATGTCTGCCACTTCTGAAATTTCATTGTAATCCCCCAGATGGTGAACTGAGCCATCTTTAGCAT
GTAGTATTAAGTTATAGCATGTAAAGAAGCAGGTCTCTGGAGCATCAAGAAGAAACTGTCTGATATCCATTACAGAATCTCCTGGAC
TCAGCTGTTGATAATAAAAACTAGAGCTTAGTGAGCCACTAAAACAGGAGGCAAAGAAAGGCTCCAAAGAACAAAGTTATAGTTTTA
GAACTAGTTTTACCTCAGCTACAATATTTCGTAAAAAAACAAGAGAATTCTTCTCTTACAAGTTATTTTCCTTGTCAACAATCCATG
TTGGATTTACGTTTGTCGATACCAAATGTTTGCAACTGTTTTGTCAAGTCATACTAGATAATCAAGTTCTCTGCAGTCAACCTGCCA
GACTAAGGCAACTAACCATTGGGCAAAACACTTGAAGCCTATGAAAATCCAAAGCAAAAGGCACTACTCAAATAGTGTGAGTCTTCC
ATTTGTGTGTGTCTCTTGCTTCCTTTAATGCTCTTATTTTTTTATATTTTGTTTCCCCGTTCCCCAAGCAATCCAATAGTTTCTATA
CTTCTTAAAAGATGTGACATCCTGTTTTATCTCTTTTATTTCCATGACTAGAACAATGTTTCTTTTAACAGTAATCAATTTTACATA
TTACAGAGAGAACTAACCAGCAAATATTTTAGAGAGATAAATAAGGAAAACAGAGATTAGTAATAAGTACGAATAAAGGACTAATTG
CATGTGTGTTTGTTAAGATGGCATGAAAGAATAAAGAAGCAAACATATAGAGGGGATATTGGGTATGAGCAGTCACTTCATCTACCA
AAATGAGCTACCAAGGTCCATCTGCTCCAATTTGACTGCTAGGATGGTTCTCACCACTAGTCTATCACTTGGAAGCTTGTTTACGAG
TTTCCACCTCACAACCACCAATTCCATAGATATCCATGTGTACGGCACAATTACTTGCATGTTGATGCGAACTTGCACGGTAGCAAGT
GTGTGAGACGCAAGAGATGGAGAAATAATTGACCATGAGTAGTTTTCAAGTAATATATATCAGCACAAATATTCATTGTATCAAATT
TACGGTTAATGGACCTATTTCCAGGTAGCATATACTAGCACAAATACTCATTTCATCGAATTCGTGGTTAATGGACCCAGCTAACCC
TATGAAAATGTGGCTTCAACTTATTAATAACAATTTATTCAACCAAAAAACACACTCAAGCAGTAGCACTCAATAATTAAATCCAGC
TACCTGTAACTCTAGCTTTTCTCCAGACTGGGACTTGACAGGGATGGTGTAAAGGCGAAGTTCACCTGTGCCAACAAAGCAATAGCA
TTGATAAATCCCTTCATGGCGGACAAGAAAGTGACACAGAACCATTCTTGAACCGGAAAAGAAATAAGCAAAGGATGGCTTGCAACA
AGTCCGTCAAAAGTAAGCATTATTAGATCCGGAATAGAAAGGACAAATTTTCAAAACCAACCTCTTTACACATTTAATCCCAAAAAA
GACCCATTTTGAAGTTATTTGCAAAAACCGACCTGGTTTCAGCCTTAGCACTGAAACCAGGTCGGTTTTTTTGAAAAGGAGTCCGAA
ACTTCACGGGAGTTGAAGTCCCGTGAAGTTTAGCAACTGCTAAACTTCACCTCCTAAACTTCACGGGAGTTGAACTCCCGTAAAGTT
TAGCAATGAACTCCCGTGAAGTTTAGCAATGAACTCCCGTGAAGTTTAGGAAGTTTTTTTTTCAAAAACCGACCAGTTTTCAACGCC
AAGGCTGAAACCAGGTCGGTTTTTGAAAATATTGTTGAAGGGGTCTTTTTTTGGATTAAATGTGGAAAGATGTTGGTTTTGAAAATT
TGTCCGGAATACAAAAGAAGATTACCGGATAAGAAACAATTAACATCCTTTTCATAAATATATAAGCCAGAGCTCTGCAGTAGAAAT
CATGGAAGGATGACCCAACAAAAAAAAAATACAGGAACCAAAAAAGCACTTCCACATGCATCGCGAGTTTAAGCTTCAAGACACGCA
TAAGCCCATATGCATCAAATTATGAAGCCGACAAAGTCAGCTCCGGTGAACAAGTCAATATATTTACCTCCGGCTTTCTTGGATGAC
GCCGCCACAGAGTCCCCAGCATCTTCCTTCCCGTCCTCTACCTCGTTCTCAACTGTCCCATTAGCCGTAGGATTGTTGGAGTCCCCA
ACTTCACTAGCTCCACCGTTAGTAGCTTCACCATTAGGATCTAGAGGCTTCACATTCTGTTCGGGTGGATTTGAATTTGATGTTTTT
CCTTTTATCTTTGACTTGTTAGATTTCCCAGCCATCTCTAGGTCATTGATATCAGTAAGAACGAGCAAAAACTACGGTATTAAAAGC
AAACTCGCTTGCTTCGATCATGCATATAAGGGAAACAAAAGGGAAGAGATTGTCTGCTAGCATCTCGTGAACAGTTCTCCTAATGAT
CTCAAATAAAACTCAATTTTTCAGGGTAAAAAAAAATGCTAGATTTTGTTTAAAAGAGACGGCTTTTTCATTATTAGTATTGCTTAA
TCAAGGAAAATGGCATATGAAGTACCTGATCAATTTCTACAAATAACCTGGTGCTTCCTCCAAAATAATCTACTTTACACTAATTTC
GAAGCGAAAGAACACGTGCAAACAAAAAAAAAAGCCAATCCGTTACCCAACAGAGTTATCAAAAACAAAACGAAAAAGAAAAAAATT
ATGACATTGAAGAGCAAAGGCGAGACCTTTTAGAGAGAGAAAGTGTTGGTCGAGGTTGAAGAAGTAGAGTACTGCAAAAATGGCGGC
GGCGGCGGGGGCGGCGGCAGAGAGATTGATTGATTGGAGAAGCCCTCGTCGCTTTGGGAAGCGAAATTGAAAAGGGGCTTTCTTCGC
TCTAATAATATCTCCGTAAAAATATGATTTTTAGCTTGGTTGGTATAAGTTCTCTGGGGGTATAGTTGGAATAACACAAAAGAGAGG
CAAATTGGGTTTGCGGCTAATGATGAGGTTTTGCTAGGGTTTTGGCCTTGGGATAATTTTAGCTATGGGATTAAAAAAAAGACCTAT
TTTGCTAAATAATTAGCAAAACCTACCGTTTTGCTAATCATTTAGCAAAACCGATGTCAGTTTTGCTAAATTGGTCTTCGAACACA

Fig. 13Z

TACGAGACTACTAGTCCCCTATATAACAAAACTCATTGTGGCTTAGGTTTAGTGGTTAATTAGTGGCCCTAAACATACGGGACTAGT
AAACCCGTGGGTTTTCGAAGACCCAATTTAGCAAAACCGACATCTTTTTGGCCAACGGGCCAAAAGATGTCGGTTTTGCTAAATAAT
TACCAAAACGGTCGGTTTTGCTAATTATTTAGCAATATAAGTCTTTTTTTAAAGAAATCCCCTTTTAGCTATTTCTTGAGGGTATTG
TGGGGATTTGAGTAATCGAAATCACTAAATTTTAGTGGTTTGCACTTATTTCTTATTAATGAGTACTTACCCTCTCCTATCGAAAGC
ATAAATTAATGTCAAAGCTTATATGTTAAGCTTTTGTCCTGCGAATATAGTTCAAATTAGTTAAGGTTATACTCTTTCAAATTGCAT
CCAACATGCTAATAATTGCTGAATTTGGGAAAGTAGAATTTTACACATAATTGTGTATAGTTATAAGATTCTATTCTGCTGCTCCTA
CTCTTAGTCACAATCTCGTAAGATCATACTTTTTGGATGTCTTTAAATGTGTGGAAACAATGGAATCTTGTTATAAAAATACATGAG
CAAGGAATTTTTTTTTTTTAAATTCATGTCATACTCAATATCATTTTTCATGTGTCTCCGGATTCTATACATATGGAGGAAGCATTT
CATGTCCAGTTACAAATTCGTATTTGTTAGGTTCAAAATTCATAAAGGATTGCAAGGAAACTTTCTTGACCATTAAGAAGTCTACAC
ATGTAATTCATCTCAATCTTCACAATAAGGGGGTGTTAGTTTCTTTTTTTTTTTTTTTTTGGATATATAGGGTGGATTACAAATTCTAGG
ATGAAAAAGTAGAATTTTGTAAGTTTATGGATTCCATAACCTTTGTTTGATACAAAATAAATTTTGGGATATTGAATACCAAATAAT
ACAAAACTAATATACTATAGTATTTGTGAATTCCCCTCTTTGAGAAAGGATTTGGGCTAGATTTCAAATTCTAAAATTTGTAATGCT
ATAATTTGAGTTTGAGACAAACAAAATACAAATAATAAGATTACATATCCCGAAATATTGATGTAGCAAACAGCATTTTATAAATCT
CAACCCATGTTAAAAAAAAACCCTATGGATTTCAAATCCCATGATGAAATCCATATCATAAAATCATAGGATTTGAGTTTGAAACAA
ACAAAATACAAGGAAACTTTTTTGACCAACAAGAAGTCTACACATATAATCCATTGTAGTCATCGAAACATTGACGCACGTCTTCCT
CTTCATCACTCCAATAAAAATAATAGAATGAAAGTAATAAAAAAGAAACTCTTTCATCAAGCCAGCGGATTCGTCGAGATGCCCAAT
TTCCCATCGTCCTCCCACAATCGGAAGATGAATCAACAAATTTTAATGGGTTTCAACAAATGGGATTTTGGGGGTACTAGGGACGAGG
GTGCTACAACAAATTTTAATGAGTTTCTAACAATTACAAAAAAACTTTTATTTCTTTACATCATCAAAGAATCTCATTTTATTGTTT
TCTAACTTCAGTGCGGTTGATCGAGTATATGCCTACAAACTAAGGAGTGCTAATCTATTCCTCTATAATGATGGGAGTCCTCAAGAT
TCGTTATTCATGCTGCAGAAATACTACATCATTGTTACTATAGCACAGACGTTTAATAAATTATTGTAGAATTGTTGCTGTAGCACA
AGCGGGGAACTGAAGCGTTTAAAATATTACTGTAGCATTATTACTGTAGTGTTTTAGAAATGTTACTGGCACACTTACAGAAAACTG
TATTTGTGCACACTAGTTGCATATAAGCTAAAAATTAATGTTTGAAAACAACATTTTCTTGAAAAAGAAATTACTCTTTTTCACGTT
TTTTATTTTAAGTTTTTAACATGTCTTTTTTTTTACATCTTTTGTTTTTATACCTTCATACTCAAGAAGAAGAAGTTTCTTTGCGCG
GCATTGATCCTCTTCGCCGCTAAAATTGTTTCTTTGTATAATAATTAGACTATATTTTTATCTTGGGGTTTGCTCCAACATCTCAAA
TTTGTTTTTTCTTTTTCCTTAACTGACATCCCTGGCTTGAAAGTAGGGTGGTAAACGATCGAATCGAATCAAATACTAAGATGTTTG
TATTTGTATTTGTTTAAAATTATCGAATTCGAATGTGGACTCTAAAATTCATATATCTAGTTTTTCGAATTCGAACTCGAATACTTG
GTATTTGATAAATATTCATGAATATTCACGAATACTTATTGAATATCAAAGTATATTTATTCCCTAAAGAATTTGATTTTCAAATA
GTATTTGAATTCATAAATAAAATTTATTCCTTTATAATATATGATGTATATATATATTTAAATCAAAATTTTAATTAGAAAACAGATTT
AAGATTATTTAAGTCTTAAAATCAGGATATAAAGCTCAAGTAGAAATGATATGTAGGTTAAAAATATGACATCATATGTGCAATATA
TACAAGTAATATGATGTGATCAAATTTTAAACGAATATTTAATAGACAAACGAATCGAATATACATCTGGTTAAATTCTATTTGTTA
GTAAACTCGAATACTAAAAAATATTTGTTTAGTGGTAAATGAACTACCGAATCGAATATGACCGAATACTTTTTCGAACAAGTATCG
AACTATTTGTTAATTATTTGGTTCATTTCCACCCCTACTTGAAAGAAATGTGTTAGAAAATAGTATGAAAAAAGGGATGATTACTTT
TCTCATATGAAAGGAGTTAATCTTGACTGTGGATTCTGTGTGCGAAGCTCGCATTTTATACGTGTGGTAATATTTTCATAGGTGATT
AAAGAGTTTTTACAGATTCCCTTAAAAAAATTCATATCTTTGAACCAATCATTCGATTCATGGAAATTGCTCCTCCAATTCGTGTAA
GTCGTTTCAAATTAATCCCTCTAATTACTACTTAACTCTTGATTAGGGAGAGACTGATTCAAAAATTAGGAAATTGATAATCTTCAC
AAAAAAAAACTGTAGAAATTGTAAGTACAGCTGCTCATGGCAAGGCATCAACCAATAAACAATGGCACGAGCAGATAATCCATCCAC
CAAGGACCAAATATGATATGCTCTAGCAACATAATTCACAATTATTCAGAACAAAACCATTGTTTTTAACAACAATTCATGTACAAC
TTCTTTCCTTGAATCAAAGAATGACGCATACCAAATTAACCCATGGCTTCATCCAGTGAACACATTGATTTCACAGCTCCTGCTTTC
TTTACGTCTGAAGGAGCGGAGATACAACGCTATATAGTTCATGCTACAGACACACAGAAACAACAATGAGGAATAGCAAGCACGAGG
AAATTATACCGATGATTTGTCATAGAAACGGCTCCTTCCACTCTAATCTGTTAAGTGAATCGATGATTGCCTTGCGAAATGCATCGT
TATGAAGGAGAAAGGATGAGACATGCCCACCGGTTACCCATCTCACCTCCGAGCCTGGCCATGCTCGCTGGAGTTCAATGACAGAGT
GTTTAGGTATATAGCCATCATCCTGAGGACAATAAGGATTAGTACCGAGAAGATCACAAACAAGGAATCTCAAACAAGGAATCTCAA
AAAGATGGGATTGATTGCAGAAACACACCCTATGCTATGATGGTGCAATCCCATATATTCAATAAGCATTTTTAAGCACGGCGTCAC
TTTTTTATGCTATTATTTGCTTCTAGTTTAGTCCAGTAAAATAAGACATTATTTTTTGCCCTCTAAGTTGGTCCTTCTCTTCCTGTC
CTTTTTCCTGGCAAATTCAGGTAAGCCATATTACGTGATTTCCCTGTGACGTCTCAACCTAATTTGGAAAATAATATGTCGCAGGCG
TGTGCCCTACATCTCAGCCTAGTTTGGAAAATAATATGTCNNNNNNNNNNNGGTATAAGTAGCTACACTAGTGCACAATATAACGTGT
ATCTGCCATTAACCCAAAAAGACATATTAGTAATAAGGTAATGCTTCCTGTCTTCTTTCCTGGTTCATTGGTTAATTACAGAACAAG
TACTTCAGATTGCTGATAGTCTTAAAGATATTGTCAAGCAAAAGATTTCACCATAAATATTACCCCTCCATTCATCAACCACTTCTA
GTGATTAGATGCATCATAAGTAGGTCAAAGACTGAATGTGAAATATACGATGTTGTGGTTCCGCTTTCAATTTGGAGAGTATCTAAA
TTTAGACCCAGGAGATGTTGAGCTCAATAAGCAACAGATTGAAGGCTTGTTATCCTTCTAGTTATATTTTTTCTAGAAGGTCTAAAAT
CAGATATGACAGGAAAGAGGCAGCTGAGAAAAAATCAGACTAACCGTGGCAGCAACAAAAATGACAGCTTGAGGATTTTTAGGAGTTG
GAAAGCGAGTGACATCAGTCAATGACAGTACCGATCGCAAACGCTCCCTCACTTGTTCAAGTGTCATTTCTGCCTTTTCGGCTGCAT
CTGCTCGAAGAGCTTCCCAAGCAGTGGCATGCTGCAAGATGCCTTCGCAGAAAGCTACAACAGCAGAGTGCGGTGCTAGAAATGGCA
GCGTGGCAACAGGAGTAGGATGTAAAGACCCAACCATCGCAGCATGTACACCCCCTGGAAATATATCAAAATTTCAAATACTAAGCT
TTAAAGACCAATTTCAAAATTGAGGAAATGTAATTTAGCTTGGTATGACTAAAGTCGTTAGTCTAGAAAGATAGTTTTTAAGGAGC
TGATTGTGGATACACTTGATTGCAGATAGACCCCCTGCAGTTCTATTGTGGAGATGGACCCTGAGTGAACAGATGGAACCTTGAGTG
ATTTTTTTTAATTTATAATTGGCCTCTTTCATGTTAGGAGGTTTACTTATAAAAAACAACTTTCTCTTTCTCTGAGGGTAAAAGAGT
CAAAATATTTCACGCCGGGGTCTATCTGCAACAAGAAAACTATAGTGCCTCTATCCAAAACTGGGCAGTAGTACAAGGGATCTATC
TGTAAAACTCTTAAAAATTAACTATGGAGCTATTTAGCTAGTTTTCTAGTTTTTAATATAAAGGTGTAACTTTTGGGGGGATTGATT
ATCTGAGCAGAACCTATTCCAGATTAATCAATTTCTTATTTGCATATATTAAAGCAGAACTTGAACACTTTTCATTACCCATGCTAA

Fig. 13AA

GCCCACAAATTCCCGTCTTTCCAAAACCAGCCTCAACCTCTAACCAGTGTAACAGACTGCGGCTTCCTCAATGGTGGCTCTTCCTA
GTAACAGCAAGTCGCTGACACATTGAAGCTTTGCACCACGCTGCAGCACGGGACCGCCGCTCTCCATAGAATGGCTGCAGCAGATTT
AGCTTGGGTTAATACCTACAATTGCCAAAAGGAAAGCCATAGTTTTTGCATCCATGTATCTAGTGCTTGTAAAAAGAGTTGACAGGA
AACACTTCCCACCTCTCAAGCACCATTGTTGCTATATTCTCTTTCAATAATGGTCCACCAAGCCGCAGTCTTCGTTCAAATGAATGG
TCCCCGGTGCCTGCAAAATTCCAGCATGCCATTTACCCTTATGTAACATGATTCATAAATAGTCCAAAAGTTTCAAGAAAAAAAACTA
TAGGGAAATTAATGGTTTATGTATCTCCTCTTTATCCTATCTTATTTATACTTCATAGGTCACTTCAAAGTTCAAATCTTTGGTGAG
GGCTTTGCAAAAACATAGAATAAAACCTAAAAGAAAAAATGTCCTGACAGGACACAGGTGTCAACCCTTTGTAAAAACATGAGGGAA
AAAAAAAGGACAAATTTTTAAAACCGACCCCTTTGGATTTTTAATTGCAAAAAACAACCTATTTCAGTTTTATTTATAAAAACCGAC
CCAGTTGGTTGAAACTGGGTCGGTTTTTGAAATTTTTTCTTCCAAACTTCACGGGAGTTCAACTCCCGTGAAGTTTTGTTATGAGAA
AAACTTCACGGGAGTTCAACTCCCGTGAAGTTTTCCAAAAAAAATTTAAAAAAACCGACCTGTTTTCAGCTAAATAGATCGATTTTTG
TAAATATTTTCAAAACCGGTCGTTTTTTGTAATTAAAAACCCAAAAGGGTCGGTTTTGAAAATTTGTCCGAAAAAAAAAGGTTGTAT
GCACTTCCAAAATTACGTTAGTATACAAATTCTTACACTTGGTTTTGTGGAGCCATATCCAGTGTCTAGATTCTTATAAGTCATAAG
TAAAGGATAGTAAATGAATAGATTTTAATCTAGAGGAAATTAAGACAAATTGAGCATTTACTATCTCTTGACTACTCTGACATGGTG
ATACTAATTTATGCATATGTGATAACAAATCCCATAACAATTAGAGCATCAGAGCAAACGAAAATAACTTACCTGCCAAGTGAACCA
CACAGGCCATCTTCTGCGGCGGTACAAATTTTGGGGCAAGGAAAGCAACCCTTGCAGTATGACTCTCAGGAGGTAATGCATTGATCA
GCATCTCATCACATGGAGTTCTGAAAATGCCCTCTCTTAGTTGTGCATTTTTGGTTTCCCACACTGTTTTCCATATGGGCTGCACCT
GACTAGGTGGCCAATTCTGTATAGCAGCGTCCGGAAAAATCTGCTTAACCATGTTCTCCAACAAATCGAGTTTGCTCCCTCCCCATC
CCCTTGAGAAAAAAGGGTGTGCTTAATTTGGTTCGGTGAAGAAATGCCCCATAAATGTGATCCAGTACATAATGAATAACTCCCAAAT
TTACTGACACCATCTCGGCATAAAGGAAAAAAAATCTCCGAAGTACTTAGAGACTGCAAGCTAGTCTTTATCCAATCTACACGAAAA
CAATCCTTATTCTTCAAAGTACTCGATCAAAACCTGCAAATGAAAGAAGGCAAATAAAATAAGTTACATGCTGATCACCACCAAAAA
GTATTTCAATATCTTTAGGAACTGAATGAGAATCAAATAGTACAGGCTACAGAGTCACACAAAGGCTACAGACTCACACAAAACAGG
AAGGGATTTCAATCTTATCTGACAAAATGTACTTTCCCATGTGTTGAATGTACTAAGTTCAACATACATGAATAGTAAAACAATAAT
AAGCCCATGAATTGCGAGACAACTATATTAACTGATAGAGAATAAAGGATAGATGCAAAAGAAGGATTCAGAATGTCAAACATCCTG
AAGGATATTGACAGTCCCTCAAATAATGAGGAACATGCATATGTTATCAACTATGGGTCTAAACTTGCTCCGGCGACAGATTCAACA
ACAACAAACAACAAAATCTTTATATCAAAACTTGATGACTGGTTAAATGAATCTTTTTCTCCATTCGCCTATCTTATGATCCATCTC
TTCCATTAAGTTAGCAAGTATAGTAATTCTTCTTACAATCTTTACTTTTTTTGAGCCAATTTTTCAGCTATAAGCTATACATAATAC
ATATTTGGCTTATTACTACCTTAATCCATTACATTTAGCTCCAGGCACTTCATCAACTATGATTCTAGCACCCCTAACAGGCCACTG
ATGATTTCTATTTGCATGTGTCCCAGCCAACTCAACTGGTTCTCTCTCATATAATCCTCAATGGATCAAATCTCTAAGTTACTATAG
ATGCCCTCACTTCTTAGTTAATTCCTTATCTCTAATGCCCTCCATAGATCAATGCGAATATCAGTAGATACCACAAAATCAAATCTC
CTATTAAGAAAGGTTTTTTTTAAATACTTCGCAGCCCTATTATATCAAAAACATCTATAATAGGTGCCATCAGTTGAAGGTTTGCCC
TTAAGTTCTCATGTGCAATTGTCGTTAAACTTATACATAGTACCATCTTTCTCTGTTTTCTTCTTTCATTACTAGGACATTTTATTC
CTTAAGCTAGGTCTCTACTCTCTAATTTCATCGTGTCTGCAAGCTCAGGTCCTTTTTTCCTCCTTACTTTTTTTTTTTGGTTTCCCA
CGAGGTATCCCCACACCTTATTATGGATGGGACCAATCCCTGTTCGTGTCATGGCTGGCACTGGCCCGAGGGTTCTTTACCTGCTGG
GGGATTCGAACACAGGACTAGCCCGCTGTCCCCCAACAAAAGCGGAGCAGGGCGCCAACCCTGCGGGTTACCTTCTACATTATTACC
CACATCATCTGAAGCTCTCAGAGTTAACCTTAACTTATTCTTTTCAATTTTTCATTATTGCCACTCCATAAAAGATGCCCTCTTTGG
TTTATCAACCCTTTGAACTTGAATTCCATTTAATTAGCAATCCAATAAGTCCAGATTATATAAGAATCTACATAAATTATTGCTACC
CAATTAAACTAACTCTCTAGCCATCATACAAAATAATAATAATAAACACAATAAATGATTAAAAATTGATTAAAACTTTGTCTACAA
ATTCCACAAATTAATTAAAGTAGCAAAAAATAAAATTTCTACTACATTCCGCAGCAGAAGAAAACCCTAATTCCCAAAAGAAAAAGA
AATTTTTTTTGCCCAAACAAATAAAGCGAAAATAACACAAAAATCAGAACTTTCACGAGGAGGGACGAGCATCAACAAATTAACAG
CAGCAACATCAAACAAACACAGAGATTGAGACCAGAACAAAACGAAGATAGTGTACCTGGATCCAAATCGACGTGCATTCGGCATGA
AACCGGCAGAAAAATCCCACGATATTCGATCGATGCCGCAATCTAATCAAGGCACCGGCATTTGCACTGGGAGCCAAAAACACGATA
AAATAAAATAAAAAATTCCGGCGAATTTTGAGGTAAACTTAAAACCCTGCCCTTCAATTTTATAACGGGAGATTTCGTACGACGGC
GGAAAACGAAAACCGTGGCCGAGGAGGGTGTGTGGGCCACACGGGAATCGCTGCGAGAGTGATAAATGGGGCCCACAATCCTTTCAG
CGGCGGGTAGTCGGGGCCGTGGACTTGGGTGTGTTTAGATTTGGATGTTAAAAAAAAAGATAAGGGTGCGCAGGCATCGGAGGGA
ATCTCGATGTTCGAAGGATAATGCCACCAGATCGGAGCTCCAATAGTAAAGGGACCGGGAAAGGTGACTCAAGATGTGACAATAGCG
GTTGACGTTTTGGGTGACGGACTTTTCAGGTTTATTTTTCTTTCGAGTGGCCTTTTAGATTAAGCTTGTAATTAGGATTAGGACGGC
TATTAGTGGGACAGATGTTATTAAAATGTTCGGGGCCGGGGATTTGTTTTTTTTTTTTTTTAAATAAGAAATGAATAATTTTGTGATA
GATTAGGTTGTTAGGAATGAATTAGGTAAGAAGTCGGATAAAGAATTGAGGATTGCAAAATAAATTCCAACTCCTCAAAATTTTAGC
TTTTTAAGTGTGATGAATTAATTGGTCGCAAAGAAATCTCATTTAAGCTAGACAATTAGTACAAAATGGCGAGGATTCTTTCAGAGG
GAAAATTTGCAAAATAGTTCGTTTTTGCTAATTATTTAACAAAATAGACCGTTTTGCTAAATAATTAGCAAAATAGACCTCTTTTTT
GCCAACAGACCAAAAAGAGGTATATTTTGCAAAACAGCTCAGAAAACATACGGGACTACTAGTCCCGTATGTTTTAATCGCCGATTA
GTGAACTCAGAAAATTTTACAAAACATTAAGATGAACTCAGAAAACATACGGGACTACTAGTCCCGTATGTTTTCTGAGTCACTAAT
CCGTGATTAAGTTGGTTCTAAACATAAGGGACTAGTAGTCCCGTATGTTTTCTGAGTCTTGTTTTTCAAAATCGACCTCTTTTTTTC
AAAAAAAAATGTTTATTTTGCTAATTATTTAGCAAAACGGTCTATTTTGCTAAATAATTAGTAAAAACGGACTATTTTGCAAATTTT
CCCTTCTTTCAGAACGATGAATGGAATAGATTAATCTATACCGTTTATATGAAGTCAGAGCGTTAGCTTGAAAATTACAGCTGTTAT
ATATGTAGTGCAAATCACCTCACTCCTATAGGAATGGGTCCGATAAGACTCTTTAGTGGAAAGTTTTAAAAGAAAAACATAAAGTTA
ACATGAAAAACTAGCATCCCACTAATAGGAGGATGAAAACGTGAATTTTCTCCTGCACAATGATTTGCTAACACCAATCCATCCAGA
TAAGAAAGAATAAAAACATACAAATGTACCAGAAGACATTAAAATATAATCCATTCAGAGATCAAACCAAACGATAAAAATGTAGAG
ATGGCTATTGCGAGATCCCAAGTTACAGTACCAACAATATAACCTCCATCCATCCAGACACAACTTTTGTTCAAATTGAGGTATTTC
CTTAAGGAGAGGCATCATTGATACCAAGTTATTACATTTCAGTACATTAGTTTACAATGATCACTTCATTATCTCGTGTCACAAGAG

Fig. 13AB

CTTGCTTCTCCTCTGATCAAGGGCTGCTGCCTGCAAAACATCAAAGCCAAAGAGCCTTTTGTGATGAGCTTCTAGCCTCAATACTCA
GTTTAACCAATGTTATCTTAATTTTAATTAACATCTGACGATATGAACCCGCGAGTTTTAGAATGATTCTGCTACTGTCACAATAGT
TGTAAGGGTGGGTTAGATATATCGATGTACTAGATGGCCTAACTACTTAATGCCTCCTGAACTACTGTATAAATGCACGCACCTCCC
GAATCTCAGACGATGTTAACTCTTTTGCCCTCAATTTACTGTCAATTGAGGGCAACATGCGACTGTACAGCAATCTGTTACTTACTG
CCACATGACAATGTCAACCAAATGTGAGAAAAAACATCGTCTGGATTTCACAGGATGACTTCATAGATAGAGAGAGAGAGAGAGAGA
GGAAGGGAAAGATTTACATTGCACGGAATTGACATTGCACTTGTTGGGAAGCTGCAGGGCTGAATCACGGTCAACTCCCGTTATCGG
AGGCCCATTTAAGAGAGCACACAGGCAATCCTGACCCAGACTCCTCACTGCATTGCAACAGACTTCACTAGGCGGCACAGTGCTAAA
CTGGGCCACTGCTGGCCTGCATGGCATCAACTGCACAAGCACAGAGAAGAACGAGGTTGAGCACGGAGACTGGCCCGTTGCAGGATG
GCCCAATAGGCCCAATATTAAGGCCCATGTTAGGATCAACAGGCATATGCTCGCTGAACCTGACTTCATTGATGATTCTATAAACAA
TGGAAAAGTGCACGAGGTTAGTTATATAGAGATATGGTGAGGTGTGAGCATGAGGGTGTCATTTTTAGAGGTTTTTGGTGGAGGTGG
TGATTGACATGAGATCGAGTGGCAAGAATTTCATGAACTTATGGTGGCGGTGGTTGTTCACGATTCATGAAGGTAAATATTGCATTT
AATATCTGCGGGCAAGTTTGATTACCAATCAAAAAAAATAAACTGATGGTTTTTGTCCTTCTAGGATTTATGAAATACAAGGCCAAG
AACCCTATAACTTAACAAACTTGGGTATGGCAAGCAAATAAGCAAAAGCAAATACAACATGCCAGAAATAATAATTCAAGAAGTGAT
GAAACAAATTGTAGGAGAAAAAAAACATAGGAGTGCATGCAAACTGGAGTTCTATTAATACAACTACACATAAACTTCATTTACTAC
ATAGAAAACATTAGTTCTAAATACAAATTGCTACCTGGTCCTGAAGTGAGAACTATCCAAATAATGCAGTAAGTGTCCTACCCTGAT
CAAACGTAACCCAACCTGAAACCGAGAAAGGGGATCAAAATATGAGCCAGTAACTTTCAGATTTTCAGTACTGAAAGTCAAGCTCGT
AAATTCATTGTTAGAACAATACAGGTCACCTTGAGACAGTCTCAACAGTAAACAGCCATAAAGCTAATACTAAATACTATCGCTAGA
ATTATTAACAGATCTCTGAGAATGTGAAGAGCAAGATCCTGATTTTAACTGCCAGTTCGGTTTGAACTCAGAATGCAACCAAATTCG
TCTATCTCAATGACATAAATTACTCATGGAGCTTGATCTTCTGGGCAAGCCAGCATTGACAAAGATATTGTTCTGCCCCTCATTTCA
GTAAAGGAAAATGTCCTTTGCATACCATAAAATATGTGATAAGTTACGATTGTACGGTTGTAAATTAATATTTCTGTTATATGCAAA
CATCTTAACCATACATTATTGTTCTTTCCAGCTTTCATAGATCTGTAAAAAAAATGTACACCCTTTGCATACCTTTTTAAACCTCTCC
TTTTACAATTTTATGAAATATGCTTCAGATTATGGAGGAACATAGACTCCTAAAGAAAGAGTGAAGGATTTTCTTGATAACTTGATA
TAGCTAGTGATGAGGGCGCAGAGATGAAGCTGAAAAAAGACATCAGGGCTTTCAATTTGGTAAGACAATTGTCTATGGATTTATCAT
GAAGTCCTTTGGAGAATGGGGATTACCGACATAGAGAACGAGAGGTACCACCTTAATACCATATGATGTGAGGTTATTTGGAATTCT
ACAATTTCCTCAATGAGCTTGGCTATCCAAATTGCTTTCTTCCTAAGCTGAGTTAACATGGAGCAATACATGGGAACTCTTAACACA
AGAATTTATTAGAATTTGGATTGAGCTATCTGCAATCTGAAGGCAAGGATGTTCTCAAGAGTAATGTAGTGGCTGAGATAAGGACTA
CCATTTTGAACTTTAACATGAGTGTTGTGCCATTCAATGGTAGACACTTTGATTTCATACTTACCTATCCCATAAACCTTATCATTG
AGCATCAAGGCATCTAACAATACTGGATAAAAAACAAAGTTCAAGCCTCGTGAAAAAGAGAGTTATCTGTTAAGTTTTGAAGCAGAT
AAAAGACAAATGAATGGAACAGATTGCAAACGCTGTTTGCAACACAATACAATTTACTCGGAGAAAGGAACCTGTTTGGCGACCATT
TCTTATTTCAGTATTGACTGCATGTCCCTTCACAGTTGAACTTCATCTTGAACCTTCAATTCAAATTATACATTTCAATTAGTTTAT
TTATCAGCTTCGTGGATTACATGTGATTAGATTGCCACTTGCACTTGTCATTGTTACTCTCTCTTACAATAACTACGTTTGTTCATA
ACTCGTCTCTTGTATTGCTGATTATCCATCTCAACATTCGTTTCCTTTGAATTAAAGGATGGTTTTTTGTAGTTTTTATTATTAAAA
GGTAGACAACAATCAACAGCTAAATTTCGCAACATAAGTGATAATCGTTTGTTCTTCCATACAAATTGTGCAAGGAGATTTCATGTA
GTATGATATTCACATATTTACGATAGGTTCCCCTCATTAGTGTAGAACAAAAACCAAGTGCATAAGGTTCTCCCTTTTCATTCCTAT
AGAATTTTCATTTACTGCATAAATAATCAGCAACCTACTGGCTCCAAGGGGTTGGATAAAACTCAAAGTTCAAAACAGAGTCCAAAA
TATCAACACAAAATTCTTTTTGTAATATCTCCGAAAGATCAGAACAGAGATTTTACATGTACGAGTCCCAATCTTCATTAACTTATT
AAGCCTAACTATCAAAATAGTCCAAAAGTTCCATTGAATTTCTCAGCTGATAGGTCACCTAAAATTAGCAAGCAATAACCAATCGCA
AAATTTTCCTTGATTGCCTAATAATTAAACTTGATCAGCTAGTTTCAAAATGATGTCATTGTTCATCATGGACGGAGAGATCACATG
CAAGGTTCATAATTGAGAACGCATTTGCTTGGAAGCTGCAAGGCAGCATTGCGGTCCACACCAGCCAATGGCGGCCCATTAAGGAGA
GAACATAGGCAAGCCTGGCCCATACTTCTAATCGCCTTGCAACAGGCGCTACTAGGCGGTGAGGGGCCAAATGGCGCCACTGCCAGA
CTGCACGGAGTAAACTGCAACATCACCAAGTAGAACACTGTGGGGCACGAACCCTGGGCCACAACAGGACGGTTGAAGAGGCCCGCT
CCTATAGCCCATGCCAGCAGCACCAGATACATGCTCGCTGCACTTGGCTTCATTGATTCTTATGCGTAATAATTTTGATGAGAGATT
GGAATCATATGAGGTTTATTATATTGACAGATAAGTGTAAGGGTGTTGGTGCCAGAGGTTTTGGTGGAGGAGGTGATTGACATGAGC
TGCACTGGCAAGTAATGCATGCACTCATGGTTGCTGGAGTTCAAGTTTCATGAAGGGAGAGGGCACGTCAAATGTAAGTGGCCTGGA
CTACTGGACTAGTCAAATTTGGCTGGAAGTAGATTCAATGAATAATATTTGAGCCAAAATAACTGCTCAGAGTTGATGCACCATAC
CCCCTGTATCCTTTTCATGTTTGTTTAACATGCTTCCCTCACAGTTCCTTCCACGCCTACAGCATTAGATTTCTTTCAATAAGGAAA
GTTAACAAAGCCTTGCTCCTTCAAAGGGTTTGGTAAGGAAAGCCTAATTACCAAGGGAACCTAGCTGCAGGAATTTATTTAAAATAG
ATTACTTTCACATATTTTGTTCCGTGTCATCTCTGACGGAATTGTTCGCATATGCTAGTGTTCGCCTACTTTTTTTCTTTTTTTTAT
CACTTCCTCTTAGTTTTGATTTGGGTGATTCTTAACTAGAAGAGCTCCATTTCACCTGTTAATTGGCTTTCATGTATTTTGGCTATT
CCACATCAAGAAAGATGAGAAATGATCTCACTGGGGCTGACTCTATTGTTTTACTACTTGAATGGTAGATCTCATCCCATGCTAGAA
AAGAAATAACTTCCCCGTTTGTCTACGTATATTCTGTATTGAAATGTTTAAAACTTGGAAGAGACTTCCATTTTGGGGTTCTCTAGT
CTACTACCCGAGTGCAATTCCAGTCTAAGAATTCTACTGTAATTTATAATACATCTCCTTGTTGTAATTATGGTCAACAAACTTGGG
TGTGCAAAACAAAGTGAGGAAAGCAAAAAAAAAATTGTCAACTTTTATTAGATCTCAAAAAATGACAATAAATATAAAGGAACAAGAA
CAAAGAAATGAAAACATGAAGAAAGAAAGGCATTCAATAAATTATGTTCAGTTTAAACATGTTCCTCAGCAAACTGACAGGGTATAT
ACTTGCTTGTAGCCTTGTATGTATAATTGTACATACATCAAATAGTATTCAATACAATAGACATTAAAAACTCATAGGAAACATAGT
TTTAGACAAAATTTGTTACCTGTTGCACCAAATAATGAAACTGTTTCCCACTTTGATAAATAAGAGGCCCAACCTGCAATCAAACAA
GGGGGAAAAATCTCAGTGACTATAAAGCCTAACGTCAAAATCATAGCTTTGTTGTATGCCAAAGACGTGGACATATATTCACAATCT
TCTCAATCTAAAATTCCAAATATAGTTGCGAACAGATCTGTGAAAAAGGACAAGGTCCTTCATTTACCGCCTAAAAAACAGCTAGTT
ATTGACCTGCGTTAAAAAAAAAGAAAGAAAATATACATTCTTGACATGAACTCCTGCGTCCCTTGATTTCACTCAGAAATGAAACCA
AATGTCCAGCTGTTTACAATTTCTAGAACCATCATTGACAAAGATAAAGTCCGATTCATGTTCTATTAAAAGAAAATGCTACTCTAA

Fig. 13AC

GTTGATAAAAAGGCTCAGATGACTTTGCTTATATAAACAATTAAGACAAAAAATGTTTGCTAATCTCTAATTAAAGTGCTATCTTTAT
CGCATATACCTATTTCAATCTGAACCACTTAATGCCTGGCCACCGCCTTCTTCATAAATTACAAGCCATCATGAATTATCAGGCAAA
AAGTTTAAAGTTTTGAATTCCCATTCAGAACACAATGCTCACACAAATTTTAAGATGTTACACTTGAGCCCATTTTTAAGATAATAT
CCACAGCAAATATATTCATTGTTCCTAAATAAACGAACCCTAAAAGAAGACATAGCCTTCTTAAACAATCGAAAGAATTGACCCCAT
TGTTTCATTTGCTCAATCTTTTTAACCCACTCAGAGTCAATGTATTGACTGATTAAATTAGCCACAGTTTTCAATGATATGGAAGC
CAAATGAAAAGCATAAATTTGGCCAATTTCATTCATCCAGAATAAGAAAGGGAACAAATTTTGTGAGAAAGAGAGAATGGACAGCAA
TAATTTAACACAGATTAAGGAAATTGAGCATTACAGAACAACCAAGATAAGAAAAAGACATCAAACGGTTAAAGATTTCCTAAAGAA
AGCCATCCAGATTTTCTTCATTCATAACAAGAAATGAATAAACTTAACTGCAAAGAGGATCACAACATAAAATATCAGTCAACAGAG
ATTGAGCACCCTAACACTATATCAAAGCTTAAGCCCTCTCCCCTCAAATGCTTCCCACTGACTGACAATCCTTCGGCATAATTGTAA
CTCTCTTCGCATGAATTGCGCACGGACTTGTATTCTCATATAACCTAACCAAATAAGCCCCCACCGCCTCCTGAAGTGCCGCCAATG
CTGACGATTAAAACCTCAGATCCACCTTAAAATCCTAAGCAAGCTTCCTCACCAGTCTCTGAACGGTAACNNNNNNNNNNNNNNNNNN
NNNNNNNNNNNNNNNNNNNNNNNNNNNNNNNNNNNNNNNNNNNNNNNNNNNNNNNNNNNNNNNNNAAGACTATATTTTACAGTGAAAT
TATTTTTTACAGGCAAATAGAACATTTGATCTTCCACAAAAGATTATTTGAGGAGAATTTCTATAGAATGGTATTCACATTGTCTAG
TTGTGTAAATCTCATAGGTCCAAAATAAAAAAACAAATGAAAAAAAATCCTCTGTGCTTATCGCCATAGAATTGTCATTCTTACGTA
TATAATCACCGACCTAGTGCCTGGTTGGATAAAATTCAACACCGAAACTGAGTCCAATTTTTCAAGTCTTAGCCATCAATATATTAT
ATGTGGTATCTTAAAAAGACCAAGAGATAGATTTACCTAAACCGAGCTCCGATTTTTGTTTTTAGCTGATCAAACCTGAATACTACT
CAAATCCCTCAAAAGTTCTATCGAATCTCAAAAATCAAAAATAGACAGCCTACACAGGATAATCATATCAGCCCCTGACATTACCTA
ACAATGGAACTTGATCAGCAGGTTTGTTAACAATGTTATTGTTTCCATAAGAACAATGGATACATGGATAGCGAGATTACATGCAAG
GCTCGTAATTGAGAAAGCACTTGCTAGGAAGCTGCAAAGAAGAATTGCGGTCCACGCCAGTCAATGGGGCCCATTTAGGAAAGAAC
AGAAGCAAGTCTGGCCAATAGTCCTGATCGCATCGCAACAGGCCTTGCTAGGGGGTGACGGGCTAATCGGCACCACTGCCGGACTGC
ACGGGGTAAACTGCATCATGATCAAGTAGAACTTTGGCAAGCACGAATCAAGGGACAGGACGGGACGGCCCAATAAGCCTGTTCCTA
TAGTACATGCTAACAACATCATGCACATGCTCACTGCATTTGGCTTCATTGGTTCTTATGCCAAATAGCCTAATGTTGATGAGAACT
TGGAGAGATACGGCGTTGATTATATAGACAGAAAGTGAGGGAAGCTCTTGATAGAGGTCAGTGAAGGAGCCGTTTGTCATGAGCTAC
ACTGGCAAGAAACGCATGCAGTTATGGCTGCTGGAGTTCATGATTCATGAAAGGAGAAGGTGCATCAAATGTAAGTGGCCTGAAGTA
GTTGAGAATTGCTTGGGATTAGATTCACTGAATAATCTTTTAAACACAATAAACTGATTATTTTTTTTATCTAGGTTCTAGCTTTAT
GCTATTGCAAGGACAAGAGCCCTAAGACTATTCTTTATAATTGCTCCAAATTGATGCAATGTACAGCCGCTATATCCTTTCAACATT
TGTTTAACATGCTTTCTTTAAATTTCCTTCCACATCCCTGTTCCTTCAAAGGATTTGCTAAGGAGAGCCTACTTCTCAAAGGGATCA
GACTCGAGGAATCTATTGATGCAATGTGCTAGTGTCTCCCTGCTTTATTCTACTTCCTCTTAATTTGAGAATTCTACATGACAGAAA
TATAGAAATGATCTAACTGGGGATGTCACCATATTGTTCTGCTACTTGAATGGTAGATCTCGTGCTAGGAAAGGAATAACTTCCTCA
CCTGTTTGTATACATTACCATAACAAATATTTTAAACTTGGAAAAGACTTCTGTTTTGGTGTTACCTAGTCTAGTATCCAAGCGACA
TTCCAATCCAAGACGAAGAATTCCACAGTGCTACTCTAAAATATATTAATCCTGAAAAATTCATGTAAAGAATATATTGATCCTAAA
AATTGGCAATAAATGGAAAGGAACAGGCATGCAGAAATAGAATTTGTTACCAGTTTCAGCAAATAAAGAATTTGTTTCCTACTTTGA
TAATGATCAGCCTTACCTACAACCATGAAAAGGGGGGTAAATACCAGTAATTTGTCAAGTCCAATGACAAAATCATAGCTTTGGTA
TAAATGACGAAAAAAGATCAGTAAATATATTCCTGCTCTTCTCAACCTAAAATTCCAAAATATTGTTACTTTCTAAGTTCATAAAAA
GGGTCGGATGACTTCTCAATCAAAATAACAAAAACAAGACGAGAACGCTATTCATTATTATACAAATTTCCACTTAAAACGCAATAA
ACCAAGGCCCCTGCCTTCCCAAAGATTACAAACCACCATGAACACGAAATTCAACATGACCTAATGTCACAAAACAAGACTACGTTG
TTTCAAATCAATCCAAAGTATAGAAACTTCATGGTTCCATTTGCGAAAAGACCAACTCAGATTAGAGATATTAGGCATTCTAACCAT
CAAAGAAACGACAAAGATATCTTAACAATTAAAGGTTTCCCAAAAAGAAAGACGTCAAATTTCATTCACCCGTANNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNTTGGTCCGTTGGATCCGTTCGTAATGGACGGACTAGATTTTATTGGGGTGAAGGACGCGGATCGTTGGCTTTGGC
CGGAGAGGGCTGGAGTGGAGTTTGGTCCGTTGGATCCGTTCGTAATGGACGGACTAGATTTTATTGGGGTGAAGGACGCGGATCGTT
GGGCTTTGGCCGGAGAGGGCTGGAAATGGTTTTGGTCCGTTGGATTTGTGCCCAATGAACGGATGAGACTTTGTTCAGAGGGACAC
GCGGATCAGGGGCTAATCTTTTCGTTTTGAAAATATTATCTGTCGTGTTAAAACTCCCGTGGGTAACTCGCAATATTTTATAGTTCA
GATTATTTTTATGTTAAAAATATAAAATGTGAAGATTTTTGCCCCCCTTTTACTTGGTCATCGTTTCCACAAAATATTGGACGGAAA
GTTCCAAATTAAGAAATATTACCACCCTAAGTAAAGGATAAATAATAGGATAATTTTTTGAAATAAGACTCTTTCATAAGAACATTC
ACTAAAATCGACCTAGTCGAGAAAATATACATTAAAATCGATCTATTTTCAGCGATATGTGTTGAAACTATGTCAATTTTGACAAAA
ATTACTTAAGAAATCTAAGAGATTGGTAATCATATGGATATTAAATGAGAATTAATCTCTACGAGATTCTAAATCCTGTAGAGATTT
CTCCTCATTTGAGTTCCACGGGATTGTTAATTTTGTGAAGTCAGTTTGACTTATAAAGTGTAAGGGATTGGCAGGTTACCTTAGAAG
ACGTTACATTGAACTTCAGGAAATTGCAGGTCACCTTTGTAAGTGAGGGAATTAAAAACAATGAGTCATTTCAGTTGAAATGCAATT
GGTTAATGAAAAAACCATTGCTAAAAAATCCAGGGAGCAATAATAAGGTTATTTGATTCAATTGTGTAGTGTGAACTTACAAGAATC
ATCAACAAAGCCAAACTCAAAGGAGTTACCTAAAGATATGCACCAACTGATACAAGAGTATGAAATAAATTTCCAGGAACTCCCTCA
TATCCCTCCTAACAGGAAGATAGATCATAATATTCCTTTAGAGGAAGGGACTAAACCTATCTGTATCAGACCATATAGACATGCACA
TTTTTTGAAAGAGGAAATTGAAAAACAGATTGATGAAATGCTTAAAAAACGTGTCATCAAACCAAGTCATAGTCCATTTTCTTCACC
AGTGGTCATGGTGAAGAAATCTGATGGTGGCTGAAGGATGTGCATAGACTACATGTCTTTAAATAAGTCTACAATCAAGGATAAATT
TCCTATTCCTGTTATAGACGAGCTACTGCATGAACTCCATGGGACTAAATTTTTCACCAAGCTTGACTTGAAATGTGGTTATCACCA
GATTAGAATGTATGAACCAAATATATCAAAGACTACCTTCAGAACACATCATGGCATTTTGAATTTTTGGTAATGCCTTTTGGTTT
GACAAATGCTCCCTCAACTTTTCAGGTTCTTATGAACAACATATTCAAACAATTACTATGGAAATCTATCTTAGTCTTCTTTGATGA
CATCTTGATATATAGCAAGAAGTGATAGGATCACCTGATTCGTCTGAGGCAAGTGTTTGATATCATGAAGGCTCACAAACTGGTGGC

Fig. 13AD

AAAAATGTCAAAATGTAGCTTTGGAAAAACACAAGTGAAGTATTTGGGGCATATCGTATCACAGGATGGAGTTGGTGCGGATCCTCA
AAAAATTAATGCCATTGTTGAGTGGTTTGCACCTAAAACTTTGAAGGGACTAAGAGGTTTTCTAGGACTAGCAGCCTACTACAGAAA
ATTTATTAAGAGTTTTAGGATGATAGCTTAGCCTCTAACAAATTTTTTGAAAAAATGAGCTTTTAATTGGACAACAAGTGCTGAAGA
TGCTTTCAAATCTCTAAAACATGCACTAACTCATCCTCCAGTTCTGGCAATGTCTGATTTCAGTATGACTTTGTCATTGAATGTGA
TGCCTCGGAGTTTGGAATTGGGGCTGTATTGATGCAATCAGAGAGGCGTATAGCATACTTCAGTTTTGCTTTAAAGGGAATAAATGT
CACTCTTTCAACCTATAAAAAGGAGCTCCTGACCATTATCCTATCTACAAAAAAATGGTAGCAATATTTACTTGGAAGGAGTTTTGT
AATTAGAACTGATCATCAAAGTCTCAGATACTTACTCGAGCAAAGAATACACACATGCATTCAGAATAAGTGGCTTGCCAAGCTGCA
TGGATTTGACTACACCGTGGAGTATAAACCTGAAAGATTAAATATGACTGCTCATGGGTTATCCAGGATCTATGAAGGTGAAGAAGC
AGTTTCAAAAGAGCCCCTTGAAGTTCCAGCTATTTCTACTATCCACAATGATTGGTTGGAAGGAGTTAAGCTCATGTGTTCCACAGA
TATATTATTCAAAGAGTTGGATGACAAGTTCCAAACATGACGATTACCAGCTGAAGACTATTACAAGAAGGAAGGGGTGTACTATTA
CAAAGACAAAATTTTTATCAGTCCTAATGCCCAACACCTCAAAACTTCTCTACTCATGGAACACCATGATAGCCCTTCTGCGGGCA
TTCTGGAATTACAAGGACACTACACAGACTAAGGAGAGCTTTTTATTAGAAGGGAATGAAGAGAGAAGTTTAAATGTATGTTCAAGC
CTGTGATGGTTGCCAATGAGCTAAAGGAGAGAATGTTGCATCATCTGGGCTCTTAAAACCACTGCCTATTCCAGATTATATTTGGGA
AGATTTGTAAATGGATTTTATTACTAGCCTGCCTAAGAGTAGAAACAAATCTGTCATTCTTGTGGTGGTTGATAGATTGACAAAATA
TGCTCACTTTTTTTGCACTCTCACACCCATATACTGCTCAGTCGGTGGCTCAATATTTTTTAAAATGGGTATTCAAGCTTCATGGTA
TGCCTAAGTCTATCGTAAGTGACAGAGATCCCTTGTTTACAAGTTCATTTTGGAGAGAGTTGTTCAAGTTGCAGGGAAGTCAACTTT
AGTTTAGTTCTTCCTATCACCCTCAAACTGATGGCAAACCGAGATAACAAATAAAAATCAAGAGGCCTCTCTAAGGTGTTTTTGTT
GCCACAAGCCTAAAGAGTGGTGTCAGTGGCTATCTATTGCAGAATTCTGGTACAATACCACTTGGAAGGTGTCTACTCTAGGGCTGT
AACTTAAAAACCGATAACCGAAAAAATAACCACACCAAAGCCGAACCATAACCGAAAAAACCGAGGAAAGAAAAAAACCGCACCAAA
CCGTAAAAAAATAACCGAAAACCGAAAGGTTTGGTGTGGTTTTGGTTTCAGATGTCTGGAAACCGAAACCGAACCGAAAAACCGATT
ATATATATTGTAAGGAAATTATATTATTTATAGATATATATTATTAATATACATAAAATTTTATGTAGAAACTTCAAACTTGGGCTT
AAATGAAGCCCAAAAAAAGAATGGTCTTAGCCTGTGTTCAAACATTACTACATAGTCTACATTAGACTTTAATTATATTTCTAGGGC
TTCTGAGAATCTGAGTTCTTGTCCATCGCCCCCAAAGTCCCAAACCCAACGAGCTTTTGGTCCTTCGCGCTCCGTCTCGTCCCCTCT
CGACGAGCTTTTGGTCCTTCGCGCTCCGTCTCGTCCCCTCTCGTCCATCGCCCTCAAATCTAGGGTTCTCCAGTCCATCGACCCCAA
ATCTTGGGTTCTTTTGTCACCGGCGAAGAAATCCCTTCTGTTACGTGGTACTGTAGCTTTTCCTTTCCCCAAATGTTGGTCATGGAG
GAGCTTGTTGCTGAACTTGAAGTGCTGATCTATCATCTACATGTTTCTGCTATTCTAGTTTTTCATCGCTTTTTTTTTCGTTTCGAA
AACTGTTATGTGGCATTGTGGGCTGCCCTTTTTCTTTTTTTTTTTCTTTTCTTTTCTTTTCGGAAATGGTTATGTAATATGAGATATT
TCTACTTTCTACTTTTCTAGACTTGTTTTCTTTATAGAATAACCGAAAAAAACCGATATAAACCAGACAAAAACCAAACCGAACACA
ATTGGTTTATGAAAAAATAATTGAAAAACCAAACCGAACCGAACCGAAAAAATAGATCGGTTTGGTGTTCGGTGTCACCTATTAACC
GCACCATTCAAACCGATTAACAGCCCTAGTCTACTCAAACTACTCCCTTTGAGGTTGTGTGTGGAAGACCTCCTCCTTCTTTGCTCT
CCTACATTCCTAAAAGTTGTAAGGTGCAAGCAGTTGATGAGGCCCCTTTCTCTAGAGATATAGCCTTGTAATTTCCGAAGGATAGCT
TAAAGGGTGCAGCTAATAAAATGAAGAAGTTTGCTTATTTGCACAGGAGTAATCGGAGCTTCAATGCGGCCGACTGGGTATTCCTCA
AACTTCAACCCTATAAACAGATTAGTGTCTCCTCACACAAGCCCCATAAACTATCTCCTAAGTATTATGGGCATTATCAAATTCTGG
AAAAAATAGGAGAAGTTGCTTACATGTGGCTCTTCCAGAACAAGCTAAAATCCACCAAGTTTTCCATGTTTCCTAACTAAAACGAAG
AATTAGAGCTGATGTTATTCTTCAGGTTGATTTTCCTACCTATGTGGAGGAGAGAGTGGATGAACCAGAGAAGATTTTGGATAGAAG
ATCAATCGTGAAGGGAAATAGATTAATATCACAGGTCCTCATCAAATGGAAGCAGCGTGCACACTTGGATTCTACCTGGGAGTCTTA
TTGGGATTTGGTTAAGAGGTTTCACACATTTGACCTCAAGACAAGGTCCAAATTAAGGGGAGAGAATTTGTCAGGGACCACTGCTTC
CAATGCTACCTCAAGGACAAATACAAACCTGTCAACTATACCGAGAGCTGCTAACCTGTCAATTGAGGACAGATACACCAACAGATA
TGCAAGTTGAAGGGTTGCTGTGCAAGATTAGAAGCTTAGGGGGTTTATCTGCAAGTATTTGTAACTACTAGGATCCTAAATAAATAC
CCAACTCAGCCTAACTGTTTTCTGTTTTCGGTTAAGTCTGTTGAGCTCTGTGCACGTGCACGAACAGTGTACGTTTGTTTTCTTTGC
TTTATTGAAGAGAGAATTGCATTGTATAAATAGTGAGATGAATCATTATGAATGAAATAAGCTGTTTCTCTCTGAGCTCTTACTCCG
TGTTCCTCAATTCTCTCTCAAATCTTTCTCAACTCTTTCTCAACTCTTTCTCAATTCTATCTCTAGCAACTCTTCTTGTTCAATTCA
TGTTCACAATGGACAGAGACATAGCCAAGAGGTTCAACAAAGGATTGAGATCATCACAATTGGAAGCTGAAGCTGCTGCTACAGAGG
ATTCCATGGAGGATCACGAGGAAATTCTTTTGATTATTTGACTATTGGATTCAATTGTAAAGAAGATCAATGCAATATTTACAATAG
GAAAGCAGACCATGGAGATCATGGCAATACTCAAAATATAGTGCAAAATCGAAGTGCCCACCGTAGATAGCGTTTTCCTTTTGTATA
AATTCCATAAATTGTAATTACCATAATACTTTTCCTTTATTGTTGCTATTATCCATGATTGATGGGAATCATGTTTGGTAGGTTTTG
CCTCATATTTGTATTTAAACATTGTTTATAAATGAGAAAACTTCAAGGTGTTCATACAATATTTATATCACCTTCATTAATTTCTTC
ATAAAGGATCGTTTTGTTTGAGTGTCTAGTTCAAATTTGAGTAGTTTTTAATTTATAATAATTAATATACGAAACGAAACTACAAAA
AGTGATGAAATTTTAATAACACATAAATTGACAAAAAATAATGACCTCATGTAAATTATTAATTTCAATATATACGTGCAGCCGTGC
TCCGTATCCTACATCTCACAAAATTATTATGTCATGTATCCGTACCCGAACCGGAACTCGTATCCGTTTCCAAGATATTATCATTGA
ACAAATAACATATTTTCCCCACTCCACATAAACATATATTCAATCTACAAACAACTTACAGGGATATGTAAATTATTTTAAATTACT
GAAAGTTAATCTAAACATGATAGAAATTCAAATACTCGATCTAAACATGTTTAGAAACTGAAAAATATAATCTATATCAAAACGGAA
GCGTAATAGATTAAACTAACCTCCAGCCATCGTTATCTTACTCAAGGATATGGATGTTGATTTCGAAGATCTTCTAAACCTTATCTC
TTCACTTAATGATGGTGTATTTTTCTTTCAAAATTGAAGAGTAGATCTAGGGACCCGAAATCTGTATGCTCCTTTTATACTCTCTCC
ATCAAAGAGCAACAAATGGAATTAGTGGGCAAAGTGGTCGGTTAATTCATAACCAACTCTCTTGATGATGGGAAGTTATTGGACCAC
CATGTGGTAAACGAAACTAACATTCTCCCACTTGGTCCAAACATTCCATCATCTTCCTTAATGAAAAACAAAATACATGAATCATGG
TGATAGGTTCTCTAATGTTGAGTAGTATCTTCCATGTATCACAATGTATCGTGTCTTTCAATCCCAAATGACTTAATGAATAAACCC
TATGTTTATTCGAGGTCCAAACTTTAATGATATTTCTCAAATAAACAAATATGTATGTGCACAAAAAAATGAGAAAAATACCAACTG
AATAAGAGTTTCAACAAAATATCAAATGTATGTACAATGAATACTTACATCATGGAACCAAGTCCCATTCTTACTACATGATCCTTG
AAATTCTTTGGTGGCATGCCTTTAATCAAAGGATCAGCAATCATCAACTCAGTGCTAAGGTGCTCAATGACCACTTTCTTTTCCTTA

Fig. 13AE

ACACGTTCTCTAATGGCCAAGTATTTGATGTCGATATGCTTACTACGACTACCACTCTTGTTATTCTTAGCCATAAAAACAGCAGCT
GAGTTGTCACAATACAATCTTATTGGCCTAGAAATTGAATCCACAATTCTAAGCCCCGACACGAAACTCTTCAACCATACACCATGT
GACGTAGCCTCAAAACATGATACGAACTCGGCCTCCATAGTGGAAGTAGCAGTCAAAGTTTGCTTTGTACTCCTCCAAGACACGGCT
CCATCGGCAAGCATGAAAATGTATGTTGATGTTGATTTGCCGTGAATCAACATAGCTAGCAAAATCCGCATCAGAGTAACCAACCAAC
TCCAAATCGTCGGTCTGTCTATATACGAGCATGTAATCCTTTGTCCCTTGAAGGTATCTCATCACCTTCTTTGCAGCTCTCCAGTGG
TCAATACCTGGGTTACTCTGATATCTTCCTAGCATTCCAACAGCAAATGCTATATCAGGTCTTGTACAGACCTGAGCATACATTAGG
CTTCCAATGGCTGAAGCATATGGAATGGTTTTCATCTGTTCCTGCTCGAGCTCATTTTTAGGGCATTGATTTAGGCTGAATCTGTCA
CCCTTCACAATAGGTGCTACACTCGGTGAACAATCCTTCATTCGAAATCTCTCTAAAACCTTTTTTATATAGGTCTCTTGAGACAAA
CCCAAAATCCCTCGAGACCTTTCCCTATTGATCTTAATGCCAATGACATAAGATGCCTCACCCATATCTTTCATATCAAAGTTCTTC
GAGAGGAACTGTTTCACCTCATATAGCAAACTTTTATCATTTGCCGGCAAGCAAAATATCATCCACATATAGCACAAGAAAGCAAAAC
TTGCTCCCACTGACCTTCTGGTATATACATTGATCCATGACGTTCTCTTCAAAACAAAATGAAGTGATAACATCATGGAATTTTAAA
TACCATTGACGAGAAGCTTGCTTTAATCCATATATGGACTTATTAAGCTTACAGACTAAGTGCTCACCATTACTAGAGGAGAAACCT
TCAGGTTGTTTCATATAAACTTCTTCCTCTAGGTTACCATTAAGAAAGGCCGTTTTCACATCCATTTGATGCAATTTCAAATCAAAA
TGGCAACCAATGCCATAATGATTCGAAGAGAATCTTTCTTAGATACAGGAGAAAATGTCTCCGTGTAGTCGATTCCCTCTCTTTGA
GTGAATCCTTTGGCAACGAGTCTGGCCTTATATCTCTCAATGTTGCCTTGTGAGTCTTTCTTTGTCTTGAAAACCCATTTACATCCA
ATGGCTTTCATACCATCAGGCAACTTGACGAGATCCCATACTCGGTTTGACGCCATAGAATCCATCTCATCCTTCATGGCATTGTAC
CATAAGTTTGAAATCTTAGAACTCATGGCTTGTGAAAACGTCTCAGGATCATTTTCGGCTCCAACATTGTAGTCAGACTCTTGTAGA
TACACGACATAGTCACTAGGAATCGCCGATTTCCTTACTCTAGTAGATCTTCTTAATGCTACATCAACATTTTCCTGAGGATCAGGA
TCATGTTGTTCAGCTGGTTGTTCAACAGCTTCAGGTATTTGTTGAACTTCAACATCTACTGAATCAGGATCATCAGCTTGTGGTATT
TCGTGAACTGGTTCTTCAACACGCGTTTGAACTATAGGCGTGTTGTTAACAACAACGACCAGTCCGTTGCTTGAAGTGGCACACTGA
GCATCTAAATGATCTTTCTCAAGACCAACGCATTGGGATCGATCGCTCCCACTAATCAAGTCATTCTCAAGAAATTTAGCATTTCTT
GATTCCACAAACCTAGTGCTATGAAATGGACAGTAAAATCTGTATCCCTTAGACCTTTTGGCATATCCAACGAAATACCCACTTAGG
GTCCTTGGGTCCAACTTCTTTTCTTGTGGATTGTAGACTCTTACTTCGGATGGACATCCCCAAACGCGTACATGTCGTAAACTTGGT
TTCCAACCTTTGAATAACTCAAAAGGAGTTTTTGAGACAGCCTTGGTTGGAACTCGGTTTAATATGTACACAGCCGTCTTAAGAGCT
TCAGTCCACAAGGATTTAGGGAGTTTGGAGCTAGCAAGCATGCTGCGCACCATGTCCAATAATGTTCGGTTTCTTCTTTCAGCTACT
CCATTTTGGTCCGGAGAGCCAGGCAAAGTATATTGGGCAACAATCCCATTTTCACTAAGAAACCTTGCAAATGGACCATTTGCATGG
CCACTCTCAGTGTATCTACCATAGTATTCTCCACATCTATCGGATCTCACGATCTTAATTTGTTTGCCACATTGTTTCTCTACTTCT
GCTTTAAACACCTTAAAAGCATCTAGTGCTTTATTCTTACTGTTAAGCAAGTAGAGATACATGTATCGCGAGTAATCATCTATGAAA
GAGATGAAGTACTTATCACGGTATGCAACCATGTCTGGACAACAAATGTCAGTGTGTATGATTTCCAATAATTCAGAACTTCTTTTG
GCACCTTTTTTGGACTTGTTAGTCTGCTTACCCTTAATGCAGCTTATACAAGTCTCAAAGTCAGTAAAATCCAAAGTACCAAGTACC
CCATCATTTACTAACCTTTTAATTCTATCAATGGAGATATGTCCCAATCTCCGATGCCATAATATAGAAGATTCTTCATTCACAACA
CATCGTTTAGTACCAACATTTTCATGAACGTGCATAGAAGTATGGTTTTCATCATTTTGCAAATTAAGGAGGAAAAGACCATCAGAC
AAAGTACCACATCCAATAACATCAGATTTATAAGACAAATTAAATCCGAAATCTGAAAAGTTAAAGGAATAACCATCTGATACAAGT
CTGGAAACTAAAATTAAATTCCTAGAAAAACTAGGAATATAAAACGTCTTTTCTAAACTTAAAATAAAACCACTACTTAAAACCAGT
CTGCACGTGCCAATGGCCTCCACATGTGAGGGCATCTTATTTCCTGAATAGACGCTGTGCTCACTTCCCATCGGCTTCCGCAGGTCT
CGTAAATCCTGCAATGGATTGGTGACATGGATTGTAGAACCAGAATCAATCCACCATGTGTTATGATTAGCATCAATCATATTGGAT
TCATAACAAACAAAAGAAAGTTGAGTACCTTTCTTATCAAGCCACTTCATGAACTTGGAGCATTGTTTCTTAACGTGCCCCTTCTTT
TTGCAAAAGAAGCACACAATCTCTTTCTTAATGTCCTTTTGAGGAGGGATTTTCCCTTTCCCCTTGTCCTTGGCTTGATCCTTCTTC
TTGTACTTTCCCGGGGTAGTAAAGTTCACAATTTCCTTTTCCTTTTCCTTTTCCTTTTCCTCCATAAGCAGCATGCCCTCTTCCTGA
ACACACATGGTCAACAATTCATTGATCGACCATTTGTCCTTATGTGTGTTGTAGGATATCTTAAATGGGCCATATTGCTGAGGTAAG
GTGCAAAGGATGTAGTGAACCAGGAAGGCTTCAGACATCTCAACCTCTAATACATTTAACTGAGCCGCAATGTCCCTCATGCGCATG
ATATGATCACGCACACCCCTTACGCTGGTGAGCCTCAAGGATGAAAACTGTATGATCAGGGTGCTCGCCATTGCTTTGTCTGAAGTG
GCGAACTGCTCATCGATAGCCTTTAGTAAATCTTGGACCTTGTCAACCTGCTCGACTGAACCCCTTATACCAGCAGAAATTTTAGTC
TTTATGAACATCACACAGAGACGATTGGATCGTTCCCATTTTTCATAAAGCTGAATTTCGTCTAAAGTGCTGATTTCAGTAACTGTA
GGGGTTCAATCTTCCTTATGGCATAGTCTATGTCCATCCATCCCAAATGAAGGAGAACTCTCTCCTTCCACACTTTGTAGTTGTCC
CCTTTGAGTTCGGGAACATCACATTTCATATCAGAGTAATTAGCAGGTGGAATTGCTGCAATAAATTAAATAATCATGCTCATGTTA
CTAATTTTGAAGCTAACAAAATATGACATGTTCTACCAATGTAAAAACATGCAAATATATAAATATAGTGACATAAAACTTGCCTGT
GGGCTAAAGTTCCAATTCAATTAGATTTATCTTAACTTCATGATAAAACTATCAAATTATTCTTTATTCCCTAATCCCTGTGGGTAA
ATTAGAAAATATAATTTGACATTTTACCCTAATTAATTAAACAGATATAATAAAAATTCATGTGGGATAAATTTTATTATATCACAT
CCGATTAATCACAATTAATGTTTACTCTTCTAAATAAGATCCTTAACAAGTGATATAACAAACCTTATTGTACAGTTTTAATTAATT
AAGGATGCTGTGGCTACTCCCAAATTAATTAAACTATATGGTTTAATTAAATAGTCATTTAATTATATTCACAGGAAAAATCACTTG
ATAAACGCAATGGATCTAACATGCATGAAAATAAACATTAACTAGAAATTGTGAAATACGTAATGTAGGCAAAAAAAAAAAAATCGAA
AGCAAGGAAAAATATTTTAGAATTCAAAGAGACCCAAGGCCCAAGGCCCATCAAAGACTTTTTAATATATGGTGTAGCCCTAGGGGT
TTGAACACCAAACCTCTAGGCCAAATCCTCAAGCCTTACCACTAGGCCATTTCCCTTAAAATATTTAATACAATCAAGATATGTATA
GATATTGAATGAACAGATCCGAATTGTTAATTAAGCAAATCAATTTGATTATCATTATACCAAGATCTTAGAACAAATGATTTTCAC
AACGAACAATTAATTAAGAAAAAACGAGAAATAAATATTATTATGGAAAATCATAACTTCTACAACCAATAGCTCTGATACCAAATG
TAAATTATTTTAAATTACTGAAAGTTAATCTAAACATGATAGAAATTCAAATACACGATCTAAACATGTTTAGAAACTGAAAATATA
ATCTATATCAAAACGGAAGCGTAATAGATTAAACTAACATCCAGCCATCGTTATCTTACTCAAGGATATGGATGTTGATTTCGAAGA
TCTTCTAAACCTTATCTCTTCACTTAATGATGATGTATTTTTTCTTTCAAAATTGAAGAGTAGATCTAGGGACCCGAAATCTGTATGC
TCCTTTTATACTCTCTCCATCAGAGTGCAACAAATGGAATTAGTGGGCAAAGTGGTCGGTTAATTCATAACCAACTCTCTTGATGAT

Fig. 13AF

GGGAAGTTATTGGACCACCTTGTGGTAACCGAAACTAACATAGTCATGAACATACACCTACAAGCAAAATATCTTCAGCACTCCGGC
CCAAGTAAGAAATCTAACACATGTATAATGACTGCGCTGTTGAGAACATTGAGGCTGTTTACCTACAGTGTTCACCTACCCCTGTTA
CAGTGTTTACCTACCCCAAATATTGTTCACCTATTCTCTATTATAGTGTTCACCTATCCCCATGAGAAAACTTATAAATACCCCCCT
AAATATGATTTGCAAAGTATCTCAATAGCAGACAGAGAAAGGGAAAGATACATATATAAGTAATATTATTAAGAGATATTGAGAGAG
AGAGAGCTTGTGAGAATTATTGGAGAGTATCTTGATCAAGAAAGGGTGTTCTCTTTTATCTTTTTATTTTCTAACCTCGAAATGAAT
ATAAAGAAATTGGGCGTCGTCGTTGCATCGTGAAGTAGCTCCGTAAGAACGAACAACGTTATATCTGTGAGTATTGTGATTGAACTC
GGGTTTGTTGGTTTTATTCTGTGATTCCAAGATCATTTGGGTATGTTTTGCGTCTCCGTTTGAGGCGTTCTTGTTGGCGTGTACCCT
AACAAGCGCAACCTCTTGAACCTCAATAAAAGTTCATTAACATCACTTTTTCCCTTCTCATCACTCAACCTCAATATATTTTGAATC
CTCAAAGCAAAATACAACAATAATATTTATGAACTTCCAACGGAACAAACATGAATATCAATTCAGAAACAACAAATCATGCTGGCA
TTACAATTCACATCCAAAAGACAGACAAAATTCTGCCTAACAAATCAAAGAATACAGTATCCTAATTACAACAATTCCTCTCAAACA
CTTACAACCTAACTTCTTTCAAAACTCCAGAGCCAGTTGGAGGTCTAGCAACTGCACGATGACTCAACAACCGGCTCCTGCCCCGGC
ACGACAATATTAGTCCCCTTAAGCAAAGAAGAACCGCTCCCTCCAGCATCAGGCCCATCATTCGCCACAAGCAATTTCTTACTCACA
ATACGATAAATCTCAGTAAGTGCGGTAAGAAATGCAGTCTCAACATTAGTAGCATCAAGAGCAGAAGTCTCCATGAAGAATAGGTTT
TCTTTCTCCGCGAATTCTTTTGCATCTTCAGTTGGGACTGCTCGTAGAGTTCCAAGGTCAGATTTGTTGCCGATGAGCATTATGACG
ATGTTTTTGTCGGCGTGGCTTCGGAGTTCTTCGAGCCATCTAGCTACGTGATCGAAGGTGACACGCTTGGTCATATCCTAGACTAGC
ATTGCTCCTACTGCTCCTCTGTAGTATGCACTTGTCACAGCCCGATACCTATATCAGCGCAAAGCATAGCTGGTGGTTTCAGTAATA
CTTATCCGTTACATAGGTTAATAACAGTTTTACATAATCTAGCATGGAACTCTGGCATTATTAATTAGGCACAAACTTATATCAGTA
GATAATAAATGCATCAGTTTAATTCAGAAAAAGATACATTAGGCTACAGTTAGAAAAACACTGTATATAAAAACTATTTTGGTTATG
AATCTTATGATTTTTTCTTGTTCGATGAAGTTTAGTCCAAATATGTACAGGAGTTAATGTAAACAGTGAGAGAACAGGTCATGGAAC
CGAATCATGTTAGCTGAAAATATAAGATAAAGTAGCTAACTAAGGCGTACAAGAATTTCTCTCCGTTGGAAGAAAATAACTGATCTCG
AAACGACAATAAACCATGGGGAATTAAATGCCACGCCAAACTTAAGATCCTCATGACAGTGAAAAATTAAACCTGATGCCGAGTTTT
CATAAAAGCTATAAACTTTTAAATGCTTTGTCACTTCAAAGAAATGACAATGGGTATTAAATGCCATGCCAAACTTAAGATCCTCAC
GACAGTTAAAAACTAAACCAAACACGGAGTTTTCATAAAAGCTATCAAAGATTACCATATCTCAATTAAACAACCAAGGCAACTATC
AGAGTTCCCAGGTAATATCACAGTGCATCAACAAATGTGTAACCAATGACTTTTAGATCGAGTTAACTTGCTAGCAAAAACTGAAAT
ATACACACATTTATAGGTTTTTAGGACGAACTACGCTGTTCAATATGCAAAATATAGATTTCACGTAAGAGTTCCTGTAACACCAGT
ATCCCAGTATCCCATATTTCATAATCTAAGAAAATAGAGCATACATAATGCCACTACAAACTTACCCAAATCACTAACCATACATGT
TCAGATATTAAGTAGGAAATGGGGACACAAACATAAATACATTGATTACTACATAGTAAACAGAATGTATCCCTATGTGTTCTCATA
GACATGTAATGCATGGAAAGTCCAAAGACACTTTCTAATAAATAATAATGACAATGTTTACATATATGCTAAACTTTGAAATGTCCA
TTTCCATGTCTTTCCAGAAGACATAGGGCTTGTCTCTTGACTTTTTATGCAATAAATTCAATGCATTTCACTTCTTATACCGAAACAT
ATCTAAACTTATGTCGATAAAGCAAAGATTTCAGCATGCCCTTTCAACAAAAAGCTGGTCTTCAAGAATTCCAAATTACATAATAAA
CAGTCACTTTAATTTTATTTTTCATAAAACTCAAGAAGTTATTAAATCATTGAAGCGAACAAAAGGTTATCAGTGAACGAGGAGTAG
AAAATCAATATAAAAACCCTCTAGGCTATCATAAAGCAAAATAAAACTTGAAGATCAGGTAGACTAGAAATTATTTCCTTTCTTCTGA
CACCCATTTCCTCAATACTTGTCGTTGACATCAAAAATTACAATCTTCACAAAAGAAAAGCCATTAACAATTTGCTAATGTCCTTTA
CATCATCAAGCAACAGCAAAAAAATCTGGATTTTTTCTGTTCTAAATCTTAATTCAAATGGTCAAATCATATCGATCACTCAGCATAA
AAAAACCATAATTTTCAATATCTTCATCCCAAACAATCAACTCTAGTATCCAAAGAAAACACAACAAAAGAATCTCGTGAATCTAAT
CATAAACAGCCCAACATATATTAATCATTAATCCCCAAATCACACAAAAAGCTAAAAGTACTCAAATCACACAGTGATCTGAGGCAT
GAAGAAACCGCGAACGATTTGTTGAAGAACAGGTTTTGAAGACTGCAGGAGTCACGTTTGAGCTTCACGGTCGACCGCGGCGTAAG
GCCGGTCGACCGCGAACGTGCACAGACTCTGGGAGGAGTCTGGCTTTGGCACGGTCGACCGTCGCGGTCGACCGTCAGACCCTGTAG
GAGTTTTCCAGGCTCTGTCGTTTGTCGCGATCGACCGTGGCGGTCGATCGCGTATCGGGTCAGGCCCATGATTGGTTTCCTGTTCTT
ATTGGGTTTTGGTGTTTGCTATAAATACCAATATACGAATTAAGGTTTCTTTGGGCTTTGATTGGAGATTGGTTGGGCATATTTGGA
GCACAGAAAAAAGAGAGTTTTTCTGAGCAATTGTTTGAGGGTTTATTTGGAGAGATTAAGAGCTTTGTTGGTGAGATTAGTTTGTTC
CTTCGAGTGATTTATAATCTTAAGTTTGTACTCTTCTTCTCTATTAGTGAAAACCCAATCTCCTTCTTGCCCCGTGGACGTAAGTAA
TTTGCCGAACCACGTAAAACTATTGTGTTTGGATTTGTGCCGTTGTTTTGATTTGTTTGGCCTTTATCTCGACGTTTGTTTGATTTG
GTTCTCGAAGCACGCCTATTTGGTTGTCCCGCTTTCGTGCCGTGCACAACAAGGCAGACCCACAAGTTTTCACATAACCTAACAGAA
CTTACCTATAATACTATAATATCATAACAAAATAATTGCCGCTTGTTGCAGGAATGAGACACATGTCACTATCCCCTCAGAATATAT
ATCATTCATGCATTTTAGCTCTCATGCTATCATCCATACATACCTCATTCGTTATTAAGATGATTTATCTCAAAAATAGATAAATAG
GTATCTATTTCCCTGTTTTAAGTTTTCCATGAGAAAATGACATCAATAGGTGTTCATTTTGAATGAATGTTTAATCAAGTCATATTA
TTAACAAGCTAAAAGGAAATTTTTATAGGACGGTTATAATACCAACAATGTTTTATGGGTCAGAGTGTTGGGCAATTAAAAAAACATG
TGCAAAAAAATGAGTATAACAGAAATGAGAATACCGCGATGATCTTGTGGCTCTAAACTAAAAGATAGAGTTAAAAATGAGTGCATCT
CTAATAAATTAGATGTTGCTCCTATTGATGATAAAATGAAAGAAAATCGACTAAGATAGTTTGGTCATGTACAACGGAAACCACTTA
GTCCACTGATTAAGAAAAGTAATGAGGCTAGAAGATCTAGAGATAAACCTAAAAGAACTTGGTTGGAAGCAAGTAAGCAGGATATGA
TTATGTTTAACTTAACGGAGGAGATGCGCCATAATGGGATGAGATAGAAGAATATGATTTATGTAGTCAATCCCAAGCACTTGGAAT
AAAAGCTTTGTTGTTGTTGTTACACTATTAACAAGCTAACACAAGCACAACAACACTTTATACCAAGTCTCATGCACCGCGCAGGTA
ACAACTAGTTTTAATCTACAAAAGCAATGCAAAAACTACATTTGGCTCCGTTTGGATACTATGGTGTTTTCCTTGTTTCCATGGTGT
TTTTGCCAAAAACAAAACACAATGTGTTTGGAAACCATGGTGTTTTTAAGCTAAATCACCATCAAACAAAAAAACACAACACTTATTT
CAAAACACCTTTTAGGTGTTTTAAGTTTGATGTTTTGGTTTTGAGTTTGAGAATGTGTTAATATAATATCTAACATAATATATTAAA
TATAATTAATATAGAGTTATTATCAACATGCTTATTATATTATACTATACACCATACTACATTATAGTTAATTTAATATATATTAGTAA
TATTTATTAAATAATATCAAAATATAATAAATAAAATATCTTATATAATAATATTAACATATTAAATACCAATATTTAATATGTTAA
TAATGTATTATATAATAAATAAATAATAATAAATATAAATAAACTAAATAAAAATAATAAAAAAGTTATTGATAATAAATAATAATA
TAATAATTATATAAATAATATATTATACAATAGTATAATCACNNNNNNNNNNNNNNNNNNNNNNNNNNNNNNNNNNNNNNNNNNNNNN

Fig. 13AG

NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNATTATTATAAAAATATTAATATAATGTACAACAATAACAAATTCATATAC
CAAAATAATTAAATATATAATTATTTGAAAATAGTATGTAATAATTATAATATAATAATAAATATAATATAATATAACTCATTAAAG
TATAATATAATATTATAATACATTATACAATATTATATTGCATTACATTTAATACTTATAATACTATAATAATGTAAACTAAATATT
ATAATATTTTATTTATAATATATTTTATTATAATTAATATAGAATATATTAACAATATTTTTAATATTAATGTTATAATGAGTCAAA
CTAGTGTTGATCAAAAATACTTAACATGATGTTTTGAAATCATTTTAAGGGAAAAACACAACATCATGGTGTTTTTTACACAACAAG
AAAAACACAATGGTATCCAAGTGAATGAATAAACCACTACAATTATAATTGAAAATTAAAAATAGCAAACAACCAACCACAACTTAC
CCAACAACTCAAAAGCAACCATTAAAAAAATAGAGAAAATTAAACAAGCTATCACCTTTCTTGACCGGCGGTATCCCAAATCTGAGC
CTTGACAGTCTTATGATCAATCGCAAGCGTCCGAGTCTGAAACTCAACCCCAATCGTAGCCTTCGAGTCCAAACTGAACTCGTTCCT
CGAGAACCGAGCAAGGAGCTGGGATTTCCCCACCGCCGAGTCCCCGATCAGCACCACCTTGAACACGTAATCGATCTTCTGGTTGAA
ATCTCCGTGCAAATTCGCCATCAGCTAACAAAACGAACAGAAACCCTAATCGATCGATTGGTTGCGGGGGCTAGGGTTGGATCGTCA
TGAGATATCCCTCGATCTCTCACTCCCTGTCTCTGGATTTGATCGATTCTTTGCCGATTTTGGATTTCGGGGGTGGGATTGAGAAA
TTAGGGTTTTGAAAATTTGGAAAGGGATCAAGAAATGGGAATTGGGAAATGAGTCATGATCTCGTTCGTGTCCATGACATGCATGA
GAGCGCGAGGGGAAGGTATGAATAAAGGCTTAATTTCATATAAGCCCCTTAACTTTGGCGTGTTTCGCATAACCCCTTAAAACTTCG
TTTATCTTGCATAACTCCCTAAGATTAGCGCGTCTCACAAAATCACGCTTAAATTTAACGTTAATTTTTCCTCAGAGTAAAATTTT
AGTTATTTTTCAAATTATACACAAATGAGTCTGGTGAGAAAAGGTTAAAGCTCAGAGAAATTTTGTGAGGAACCCCAAAGATTTCGG
GGGATTGTATTAGATAAACAAAATGCGAAGGGTTTATGTACAACACCCGCCGCTTTGGCCCATAAATAAGCTTTTCGACTTTTGCAA
AACATACCCTCAAGTTCCAACGAACTTGTGCTTTAGATTTCATTATTTTCAGACGAAACCTTTGGTGAACGGTCTCGGCAAACTCGA
CGTCTTTGGAGGTGCAATTGGATGTGACAAATCAATGGTCCAGTACCCGACCCATTAACATGCCCTCTTAGACCCGACCCGTTAACC
ACCCTTTAGTCTATCGATAACCGTTGATCCCTCCGCTCTTCAAAAATAACCCAAAAATAATAAGGAAAAAAAAAACAAAGAATGCTC
AAAACCAGAATTCTCATGAGAGCCCTCTCCTCCCTTTCCCGCCAAAATTCAAACTCTCAGTGTCTACTCCCCAACGGTCAACTAGAG
GATGCGCTTGTAAAAATGTCCACGGTAGGATTAGAATTAGATTTTCGGAGCTACGATTCTGTCCTCGACGCATGCATGAATGGAAGG
GCCTATAGAGAGGGTCAACGGGTCCACTCTCATATGACCAAGACCCGTTACCCCATGCAAGTTTACCTCAACACAAGGCTTGTGATC
TTCTATGTCAAGTGTGATGCTCTTGACGACGCACGCCAACTGTTTGAGGAAATGCCCGGGAGGAGTATTGTTTCGTGGACTGCGATG
GTATCAGGGTATTCGAAAAAGGGTCTTCATTCGGAGGCCTTGGGTTTATTCGTTCGGATGATGGTGACAGGTGAATTGAGTCATATT
GTTTGATATTGTATGGTTATTTGCACACCCAAATAGTTATTAATCATTTTCATATATTATACGCCACTTCACATTCGTGTACAACAT
TGCTCGTCATATGCTAATTCCATTTTCATTGAATATAGTGAAATTATAACGTTAATTGCACATAGACACCTTTTAGTATCTTTGTTT
TGCACTTAGTGGCCATGTAGTCTTGTTATTGCAGATGAACCCCTAGGTCTAAACTTTTTGACTCTTTTACCCTTGGCGAAATTTCGG
CAAATATTGCCCCTAAGTGAAATTAGTGAGTCTATCTCATGGTAAAATAGTTAAAAAAAAAACCACGGGGTCTATCTGCTGAAACGAC
AGATGATGTAACTTTAAGACAACAATAGTACATGGGGCCTATGTGCAATTAACCCAAGATTATATTCAATGGTACTCTCAATGAAGT
TGACCTTGTAAAGTGTGAATATTGAAAGTACATAAAATGGTATTATTCTCAGATCTCTTACCAAATCAACACACTTTGGCTTCAATT
CTTACATCTTGTGCTGGTCTTTATGGCCTCCAGCATGGAATGCAAGTCCACTCCCTGTCCATCAAGCTCAACTTCGAATCCCATATA
TTTGTTGGCAGTTCTCTTCTTGATATGTATGCAAAAGCTGGTGAAATTCATGAAGCAAGAAAGATATTCGAAGACCTTAGTGAAAGA
GACGTTGTCTCTTGTACTGCTATTATTTCTGGTTATGCGCAGTTAGGCCTCGACAATGAAGCCTTGGAATTATTTCGTGAGTTATAT
AAAGAGGGTATGACATGTAATTATGTCACTTTTACGAGTCTTTTGACTGCACTCTCTGGCTTAGCTGCTGTGGATTATGGAAAGCAA
GTACACTGTATCACAATTCGATCCAGACTTCCATTTTATATCGTTCTTCAGAACTCTCTTATTGACATGTACTCAAAATGTGGAAT
CTTATCTATTCGAGGAGAATTTTTGATAAAATGTGTGAGAGAAGTGTAATAAGTTGGAATGCAATGTTAGCAGGATATGCTAAGCAT
GGACTAGGGAATGAAGTTATCAAACTTTTCAATTCCATGAGAGAAGTATTGAAGCCTGATTGTTCAACGTATATGGCAGTATTATCT
GGTTGTAGCCATGGTGGACTTGTTGATGAAGGTTTAAGAATTTTTGATCTCATGACTAAAGATGAAGAGGTTCATCCTGAAATTGGC
CATTATGGGTGTGTTGTTGATTTGTTAGGCAGGGCAGGCAGAATTAATGAGGCTTTTGATTTTATCAAAGATATGCCATTTGAACCA
ACAATAGCTATTTGGGGTTCACTGCTTGGTGCTTGCAGGGTTCATGTTAATGTTTCAGCTGGAGAATTTGTAGCTCAGAGGCTTTTA
CATCTGGAGCCAGAGAATGCAGGAAATTATGTGATTCTTTCTAATATTTATGCTTCTGCAGGAAAATGGGAGGATGTGATGCGACTG
AGAGCTTTAATGAAGGAAAATACTATTATCAAAGAGCCTGCTATAAGTTGCATCAAATTAGGTAAAATAAATCACACCTTTCACACT
AACGATCGATCTCACCCTCAAACGGAAAGAGGTTGAAGCCAACGTTAGGGAAATATATGTGAACATAAAAGAAGCTGGTTATGTTCCT
GATTTGAGCTGCATATTGCATGATGTTGATGATGAGCAAAAGGAGACGATGCTACTTGGGCACAGTGAGAAATTGGCAATAGCATTT
GGGTTGATGTGGAGTTCTCATCATGGAATATTCAGGTTATTAAGAACCTTAGGATATGTGTTGATTGTCATAATTTTGCTAAGTTT
GTATCGGTGGTTTATGGAAGAGAACTATCGTTGAGGGATAGAAGTCGGTTTCATGTAATTGTAAAAGGGTCGTGTTCTTGTGGAGAT
TACTGGTGATTTTTTGAAAGCCATAATTCTACCAAACTCTGATGATTTTAAATTGTGGAGGAAAGATAGAGAAAGAGAGCAATCCTC
GACAAGATCGAGGTGATGCACATTGTGATGGGTCTATTTCACAGGCAGCAAGGCACTTAGTACCTTCGACCAAAGGACTATGAGAGT
AGGTAAATTCTTCTACACATTTTTCAGATGACTATATTTGTTCAATTCTTTCTATGTAAATCTAATTAATACATTGACTATTGAATA
TACATGATTGGCCAAGTTTGAGCAATTCATTGTGCATCTATTTCCTTCATGTCAATGAATTGGCTCCAATGGTTATTATTTTAATGC
TGCATCGATTTTTTTAAGTTTACACGAAAGCCTTTACATTGTGAGGGAATTGTAATATTTGAACTGTAGCTTATTTGTAGTGGTGTT
GAAATTACTGGAATCTTATTTTGGCTCCTATAATAAGGAGCAAAACTGAGTTAACTAACCTATTGTAATTAACTTGTGAAAGTCATG
ATCAAATATAGTTGATATTTGAGTATTTTTACAAATGCCTGTGAGGAGATTCAAGTTAAAAGTTTCTGTTCACTAGTTTATTCTCTC
CAATGTGGTTGTTGCGAGGAATGTTTTTATTGCTCGACGATAGAACTGTATTACCACCTAGGTTGTATATACTTAAAATTCACTAAT
ATTTAGCCTCTACAACATTATGGGGTTGTTACTAGTAATATTTGTGTTACTCAGAAGATAGGACTGCTTTTGCTCTTAGGTTTTATG
CATCACTTAAAATTCATAAATGGTTAGCCTGTACATGTTTATATAATGGACAGAGTGAACTATTATAGCATGTACATGTTTGTGTTG
TGGTAAACAAGAAGCAAATATGTACTGGTTGTACTCTAATCACGTCGACTGGTATGTGATCGTATATTTGCTCTAAGCCACGCAAGC
ATGCAGAGAGCAGATATAACAAGTTCTATTCAAGCTGGATAACCATGTCTCTGAACAATTAACACCAAGGCAAGACACTTGCGTGTA
ACTGAGTTCCACGTCGCTAGTCTGGATGTTTGGCGTGAATCAGCCCTGTTTCTTGTCTTTTAAACAAGCGAGCATAACTCAGAGACA

Fig. 13AH

TCCCTTGCACACAACAATAGTGATCTAGCACAAAATAGATCTCAATATTTGGAGTTTTCATTTTAGTAACTCAACTATTGTCAGGTT
AGTTGGAATTTCATTTTATGTTATCTTTCAGTTAGAGTTTCAGTTAGAGTTTCAGAGTATAGAAATAAGATTTTGGAGTGATTCGAT
AGGGATGAAGTCAACGAACATGAAGCAAGGTCCGGTTAGGTGCTGTGAGTGAAACCAGACCTTCAGCATCACATAGTGTAACTCATA
ACTGAAGCAACATATCAGCTTACCAAGCAACATCAAATTACTGAAAGTCCAGTGCACCTCCTATCATTTTGGCAAAATTATTGTAAC
ACTTCAAGAATAGTCGAACTTAAAATTTTAACATGGAGCTGGAGTGGCCAGTTCTAACTCTATTATGCAGCTTGAGATGCAGCACAC
AAACCAAGCAACAGAAGCAAACATGACACTGCGTTTCCCTTTCAGCTCCTTTTTTGCTCATCATAAGAATGTAATCTAGAAACAAAA
TACCGCACCTCTTTTACAACCAAAATAAAGCTATCAAAACACGTACACCTATGAAATGTCACCTGAAACTACTGATATCAGCTCTCG
CAGCCTGATAATCAACTAACGCCTCTAGCAAAATGAACTTCAAGCAACATTACCGAAGGAAATTGATTAGTGCATATGATTAAAAAA
ACTCAAGCCAATATATAATCCAAAAATACCAGAGATTCCAAACACCAGAATTGCTTAAAAATTGACAAAATTCCATCAGAAATCTGA
AATTAAAGTCTATTTCACTGCTAAAATTGGTTCGAAACAGGTATGGGACTAATTTAGTCTGTTTCATCAATGACCTTGGTTCCCAAT
CCCTTGAGTCCTTCAGGAGGAACCTCTGCAACTGTGACCAACGAGTAGAGCTCTTCCTTGGCATCCTCTTCTTCGTTCCTCTTGCGG
GCAATCCTTACACGTACTCGCCTTGGAACACTTCGGATGCCACGGCTCCAGATGTGCTTGTTGAGCTTCACGTCAACTCTCACATCG
GTTGTCCCCATTGCCTTTTGAGCAAATTTCCTGATCTCCTTAATTGCCTTGGGAGCCATCTTCTTGAAAGTACTACAACAGGGATTC
AACAAAAAATGAAGATATCAGACTTAGAGAACCATTGGCCAGTTGCAACAGCTAAACTAATCTCAACATACAATAGGAATTACATTG
TAGAAGGGATTCCTACAATCAAGGAAAAAGTAAAAAACTGTGTCAAATTAGCTTCATTTAGAGTTTCTGATATCATAGTTGCCAACA
AAAAGTTTTATTAATGTTTGGAGTATTTTATAATGATCAATAAATTAAATCAACTAGATATGATCCTGAATGGCGAGAACTTACAAG
AAATTTCACTTCAATTTGGATCTAATCTTTGTTAACCAAAACGTTGTCAGAGCACATTGCATGGAGATTCAGGCTAATTGCTAAATA
TACAATTCAGAGGAAATAATTTGCAGCTATCAATACAATTACAGATCATGAAAAAATATTAGGATTATGAAAATCGGAGGAGGTGACG
TATACATTCTGACCCAAAAGAAAGACACATTCCATTCTATAAGATAAAAAAAAATGCAGCACTATTTAGGAGAATGTAAATTGTTTAA
ATGCCAGTTTTGACATTAGCGTGGCATATGAGCCAAGTTCTCGAGTGTTTCCAGAGTCGTGGTAAGTTTTAGTCTTTTAGAAGTAAA
CACAGATATTGACGCACACAATACTGATCCCAGTGGGTCGATATGTTTTGATGCCATTTCTACCGAGAATGGCATACTAAAATAATC
ACATCACTGTTTGTAGCATAATATGCATTATAAAGGGAAAAACAAGTGCAAAGCTTCCAGTATACGTTTGGATCCTTCAAAATATCTT
GATTGCTATTCTTTACTAATGTTTCGTCTAACACAAGCCATGTCCAGGTATCATGTCATTTACCATATCAAATACGGAAGAAAGGTG
CAAATGTACAGAGTTAGGCTATCATTGATATTTCTAAAGCTAGACAAAAAAAAAACATCAGTATTCTTTTCCTTTGGTTTGGGGTGCA
CGGAATAGTACATTATGGGCTCATCTTGAGAATGAAGCATATGTATGACGGGTGTTTGCGTGAGCGGGTTTGATTGCAGGAGGGTAA
GCATTACATTGTTTGGTATTTATTCCTGGTATTGTTTCTTCATACGCAAAGCTTTCTACGTATTAATGGCAACAATTGTGAATATAG
TCATTTTCTCTGTGCCCTGAACGAAACAAAGAACTACAAAGGTATCAGATATATGATAGAATCCTTGTCCCCAACTACGAATCAATA
ACGGGTCAACCTAAAAGACCAGTTAATAATTTGGTAGTCCATCTCCAATCACACTAATTTACTTGCAAAGCCATGTTACCCTACATT
CTCTCAAAAATAAAACCCCTCAATAATCCACATACTGGAAAACTATAAATTTTTTCACAATACATACTACACAATCAGGGCTAGACC
CAAAGATTCTTCACCTCTTGTAATATATTAACATCGACCAAATTCTCGAACTTTAGTTTATTTGAGTAGCATTTCAATGCTAAATCT
TTAAAGCTAACGTTCATTATAACGACCATATTCGATATAAATTTTTTTTATAAAACATGTAAAGGAAAAAGCAGAAATGATTGAGAA
AAGTACCATCCATGAAGTCTTTTGTGGAGATTGATGGTGTATTCTCTCGTCACCACCTCCTCCTTCCTCCCTTTGCTTGCCTTTTCC
ACCATTTTTTTGCCGCCCCTCTCTCGCTCCAAAAACCCTAAAATTTCAAGCTTCAGCGGCTGCAGAAGAAAAACCCTAGATCGCGGAAC
TGAGGATGATATAAGGATGCTGTCCTTGTCGATATTACCATAATGCCCTTGATGTATAATACTATTGGACTGGGCCTAGTTTATGAT
TTATCCGTTAGCCCACAGGCTGTAAATGATCCATTTATTGTTTGCTACTCGGAAAAATGAGTGCGTATTCTCGCGTCCTGATTGGGA
AAAATGAGAACACATTTGTATTGTCAATACACAACAACTTTATGGGCTTATATAGAATTAGGATATATATACTTAACATTGAATTCA
ACAAATATTTGTATAATATAATTAAGGGTTTGTTATAGCAAACCACCACAAAAATATAGTTTTTTTTTTTTTTTGCAGAATCACTGTA
ATTTTTTTATTTTCATAGAGCCACTACAAAATATTCTGGTTTTTCGAAAAACCACCTCACAAATTTTATTTTTCATTGAACCACCA
TGAAAAAAATGAATCTTTTACAAAGTCTCACCAAGTCATAATTTACCTACATATTTTGTTAAATTAGTATAAAAATAACATAAATGC
CCATTATGACAAAAAATTAGAGAGGATGAGTGGGGTATTTGGAGGGCATGAAAACTTTTTTTGGCAAGGTAACAAAATTTTAGAGG
AAAATAAGGTATTTTGTTTTTTCCCCCCCCCCCCCCCCCCCCCCCCCCGCCCCTTTTTTTTTTCTTTTTTTTAATAATTGAATCCAA
GATAGTTGGGGTCATGTTGAAACCTCCCAACTATCTGGATCACCAGCGATACCCGTACATTTTGTTGGTTTGAAAAAGTATACTAAC
AAATTGACATGTCACACGATGATGGTATTTTAGGGATCTAGCATTTTAGTTTAACACGATATAGATGCAAAACTATAATTTGCTAGC
ACTTTGTTATGGATGCACATTTTTATGGCAGTTCTATAAAAATTTAAACAATTTGTGGTGGTTCTCTGCAAAACCATTATATTTTGT
GTTGGTTCTATGAAAATAAAAAAAAATTATGGTGATTTTTCAAAAAGCCACTATTTTTTGTGGTTGTTTTCTTATAAAAAAAAGCCCT
ATAATTAATCACGAGAAAATTGGCACATTTGCATTATAGAAGGTATTATTATGTAAACTTTAAAATGTTTTGAAGGTTCGTAAGTGC
CGCCAAAAATGCAATAAGGGAAACGGTAAGGTATCTTAGTGATAATCATCCAATAGTTAGTTTTTTACCTTAAATCCTGATTTGGCA
TGTCTTTTTCTCAAAAACTTGAGATATCAAGATTAAAATGGTGTTAAGTTCTGAGATATTTTTAGGTGGAAATTACCCTTGATATTT
TTAGGTGGAAATTACCCTTGATCTATAGATGCTCTTTGTATGAACCCTTGACGAAAGCCCAAAAGTTTGCTCCGCATGAACCTCACC
AAAACCAACTACTCACCTCTTAAAATCGGTAACCTCGCCGAAGCTTGGCCACACCTTTACGCACAGCGTACGAAATCAGCAAACGAA
GGAAAAAAAAATGCAAAATAGATCTATTTTGCTAGATATTTAGCAAAACCGATTGTTTTGCTAAATATTTAGCAAAATAGACCTCTT
TTTGGCCAACAGGTCAAAAAGATATCGATTTTGCTAAACAGGCCATTCGAAACATACAGGACTAATAGTCCCGTATGATTTAACTAG
TCCTGTATGTTTCGAATGATCTGTTTAGCAAAATCGATCTTTTTGGCCTGTTAGTCAAAACGGACGGTCTGTTTTGCTAAATATTTAG
CAAAACAGTCTGTTTTGTAAATATTTAGCAAAATATGTCTATTTTGCAAATTTCTTCGCAAATGAACCCAAAACTCCACTTCTAAGG
CCAACGTTCGGGATCGAAACACGTCATAGGAACAGGATAAGTTACTCGTCCCTGAAGCCTACCCTTGTGCTCACTCGCCGCTAATCC
TTCGCTGTCGTGGCTTTTAAATAGGGGTTGGAAACGTAACCAAAACTCCAATTTTTTTCTATCTCCACCCAAATTACGAGCCCTAAT
TTCCACGATTCCGAGGCGAGTTCAGAACGCTAGGGTTAGGGTTTCGACTCGATTTCTTTCAATCTTCATTAAATTTGGATCGAATCG
ATGATTAATTCGAATTCCGCTTTTTTGATTTCTGCAGGGATCGTCGTAAGCAACCTTGTAGATTGGGGGAGATCTTTGCGCCAGCGA
AGGGCGTCGTCTAATCGGTGCGTCGTGTTCGATTTCGATCAAAGCTTTCGATTTTGATCTCTAGGGTTAGGGCTTGGTTTTGTTCGA
TTGATCAATTTGTTTGTTCACTCTTCAATTTTGTTGTGATTTCGATGTAATTTTTACTGCGTGTTTGTATCAGGTAAGAAAGCGCGT

Fig. 13AI

TTGGGCCTTAGGTTTTAGGATGAAGATGAGATTTTGGGCATCTAACTGTAACTTTTTTTTGTCCGTTCTACTGAATTTTCAACTTTT
TTGCTCCCTGTTGTTTTTATTCTTATATGTATATGTGTATGATGTTTTGAAGTTTTTTTTGTCGATTATTTTCTATGCGTTAGTTCA
ATAATGTTAGATTATGCTTTAGGACGTGCGGCTTCTGCATTCTGCGTAATAAATAGGAATTTATTGTATTGGATATTCAGTGGGCTT
ACATAAAAATCAAAACTTTTAAGTCATTAAGCATATAGCTTTTACCTAGTAAACATTCACTTTGTCGTATTTCCAAGTAGTGGACT
AACCAGTAACCATCCTTTTTAATTATTGGTACAATCAAGGTTTATCTATTAATGAGTTAGTTCCATAATTTTAGACTATGCTCTGCG
CATTAAAACAAGGCTTATCTATTGTTGTGTTAGTTTGAAGATATTAGATTATCAGGCTAGAATATATGTGCCTTCTGATTCTAAGA
AATGGGCTTCTGTGGTATTGGATATCCACTAGGTGTACGTGTATGTCGTAGTTTCAGACTGTTACTAAAGCATACTGCCTTTTAGAG
AGTGGGCGTCACTTTTGTTGTATAATTCCAGTGATGTGATGTTTTAAGTATCCTTCGTTATTTATCGGTTAATTGATGCCTTAGTTT
GCTACATGTTCTTCTATAGACTATTGTTGAGATATGTATCTTTTGGTGAAATTTGACAGCCCTCTTGACAAGATTAGGTATTACTTTC
AGATAGTTAGAATCATCTATGTGTGTTGCCTTTTAGGTTGTGTAATTAGTCTTTATTTTGTCTGCCTTCCCTTTTAAGACAATTAAT
GCAATAGCTTGTGGTGATAGTTTGGTCGTCCTGCTCTCCATTGTAAGCAGGATTTGTTTCTTGAGATGGATAGTAAGTGTATTGGAA
TAACTGAGGTGCTTAAGCTCCAGCGTGTACTCTATTTTCCCTTTTAGCTTATTTGAGCTGTTCGATCAAGCTTATGATTTGAGATCT
GATGAAGCTTATGATTTTGTGGTTAGCTTTTCTCCTTGCAGTTCTATTTTTGTCTTTGTTTCAATCGAGTACCAGGATTATGTTTA
TGTTCTTTTACTGAAAATCTGTGTTGGTACAGTTCACCCACAGACTATTGAAGAGCAGCGAATCAGTTATTTCACCATAAGCTTCTC
CTNNNNNNNNNNTGTACTTGCTTTTTCAACACTTCGTGTACATGTTTTACATGCTTGTGTGTAAGAAATTAGTTTCGTTTTGATACC
CTTTCCCTCTTATATTAAGTTTTCTTTATGTAATTTGTTGATGGTTTGATGCAGAAAACTGAAACAATGGAGCACCACAATGAGACT
GGATGCCAAGCTCCGGAGGGTCCAATCCTCTGCATCAACAACTGCGGCTTCTTGTGCAGCCACCATGAATATGTGCTCCAAGTGCCA
TAAGGATCTTGTATTGAAGCAGGAACATGCTAAGCTGGCGGCATCATCCATCGACAGCATTGTGAATGGAAGTGGGAGTACCAGTGG
AAAAGAGCCCACTTGTTTCGGCCAGTGTTGATGTCGCTGTTGCTTCAGTGGAGCCAAAGATCATTTCAGCACAGCCATCTGATGCTTC
TGTCTCTAGCGAGAGCAGCGAACCAAAGGCGAAGGAGGGTCCAACCAGGTGCAATGCCTGCAAGAAAAGGGTAGGCTTGACTGGCTT
CAATTGCCGGTGTGGAAATGTATTTTGCGCGATGCATCGCTATTCGGAAAAGCATAACTGCCCATTTGATTACCGGACGGCTGCTAG
AGATGCAATTGCCAAGGCCAACCCTGTTGTCAAGGCTGAGAAGCTTGACAAGATCTAGAGATGAAAAAGAGAAGATACCGAAGTCAT
GATTCAACTCTCCCTTTTCTATCTATGCCCTTTCTTTCTCTGTTGGCTGCTTGTTTTCATTGGTGTCCTTTATCCACATAAATGGCT
GGAGGCATGACGATGATGCCTTAGGGCATCTTTGCAGTCTCGAAGAACTCGTTATCTGGTTGATTGGTAGAAAAGGTTTGCATGTTC
TGTCTAGTGTGTAAACTTTTTTATTTGGTGATGGTCTGATGGACGGTTATGTGTCTATGAATTGGTTATCTTTGTAATCTGCTATCA
TAGTTCATCTCTTACACTTTAGCACCTCGAATGGTGTGAAAAAGTGCATTCTATCTCTGTTACTGTTGTGTTTTGAACTTTTGAGGT
TTCTTTTAGCACCACCAAAGCATTTAGAAAACACATCACAAGATTCCAGCTGTATAATTTCTAAGTTAGGAGCTGTTTGGATCAGTT
TTTTGTATCGGTAAAAGAGAAGAAAACTGCCAAAAATGTCAGCTTTTTGACACCTTTTCCCCAAAATCCCCTCTTATAGAGGCGATT
TTGGCGAAAGCTGTCAAAAAGCTGACATTTTGGCAGCTTTCCCCCTCCTTTCCCCTTCCAAAAACCGGAACCAAACAGCCCCTAAT
GTCTTTGCAAGTAGTAATCCTCTATCCTCAGGGATACAGAGAATGATTGCGCTATATTTATTATCGCTTAACATTTCAAATGGACCC
CTGGTCTTGGAGCTCTGCATTTGTGTATGTTGTGTTCATTCAGGTGCCGATGCACATACATGCACCTGTGAACTGTCTTTATGTATA
CTTTAGAGCATTTTGTTGGAGGAGTGATGTTTTAGCTTTTGACGTTTATTGTTGACTTGGTTAATGGGTAAGAGTAACAGAAATGCT
TACTTAAGCAATGTACATTGGGATTTCCCTCAGAAAGGAACGCATGGGATCCTTGTGGTGAGGTCTATTTATTAATTATGCTTCTA
TGATTGGTATTTTGGGTTGTTTGACACGAATTTTAAGTATTTTCTTTATGAATCTCAGTACATTAAATCCTTTTTTATCTTTGTGAA
ATTGGTAATCTAGGCTGTGAAATTGATAAGATAGCAATGCCTTTTCAATTATGCGCATTTTTTTCTAAAGCCAAGTTGCTCATCTGA
CTTGGGAGTTTGACAAATGTTCATTGAAACGTGTGTGTGTGTGTTTTTAGGTGACTTGGGACTAATATCTAAAGCCAAGTTGCTCAT
CCTTTTTTACAGTTGAATTTCATTTAGGTGTCTTTTTTCCCCTCAAAACTTATTAGGTTGTTCTGCATTCTATTGCAAAATTTTGGT
ATTTGGTTTTTAGATATTAGTCCCTTAAATCTTCCGCACTTCGAAATTTGTCCCTCAAATCATGGCTTGCTATTAGGTCCCTTAATC
TATTTTGAAATTAGTCCCTCAAATCATTGAATTTTCTATTAAGTTTCAAAAATCTCAAGTCATTTTGAAATTAGTCCCTCAAATCAA
GAGTAAGAACAGCAAATAGAGACCAATTGCTCGCTTAAAATCACTGAAATCGTGATCAGATTCCCAAATTCTCGTAAGTCATTTTAA
ATTAATCCCTCTGGTTCCTACTTTTATTCTTCATTGGAGGGACTGATTCAAAAACAGCTTAAGATTTGGGGGCTTAACAGTAATTTC
CATGATTAATTTGAGGGACTATTTTTAAAATAACTTTAAGACACCGAGGGATGTAACTTCCATGATTTGATGAGAACATGTTTGAATG
ACGAAGAATAATAAATATAAAATGAAAGAAAAAGAGAGCACTCTCTACTTCTTCCAGTGGTTTTTTGTTGCTAAAAAATTGTAGCGT
AGAACAAATTAACACAGTAAACAAAATGGTTTCATTTATTCATTTCATAAACGAGGGGAACAAAAAATACACCAACCTCCAACCAA
CCAATGTCTCAAACCAAACAATAAGGGAAATAGTGAATCATAAATAAGGACATTAAACAAATTACGCCACAAATCATTCCCTAATTG
CATTGTTAACCCACAACTTAATTAACTCTCATCTCCTTCGTACTGATCTCTTGTTACTGCAAGTAGAGAGCAAGGAAAGAGAGAGCA
GAGGCTCCGATGAGAGCCCCGACGGCCGGGCCAACATCGAACGATGCGCTGGTGGGGCTGCCATCGCAGTGGTCGCTGAAGCTGCG
GCGACGAGGACGGCGCAGACCATCTTCTTCATCTCCATATCTCTATAGGAATTTTCAGGCTGATGATTATAAGGGTTTTTGGAGAAG
AGAATGGAGTTTTGCGTTGTGAAAGCTTGAAGAGAGAGGGAGGAGGAGGGAGGGTTTTTATAGTGGGAGGAGGGTGGGAGCTGGAGT
TGTTAATAGTTTTGAGGTGATTAGTTTATTGGATTGTTATTGTTAAGATTTTTTTTAGAGGGGGTTTGGTGGCCTCCATGTGTTTGG
AGATGGGGTTTTATATATGTGCTTGCATGTGGGAAAGTGTTCTATTGGATTTGGGTTTATGAGGAGTTTACCCGTAATCAAACCGGA
TCCATATGAAGGATACCTGGATTCGGGTTAAGTTGGTAGTGGTGCAATACAAATGTCAGCTTATCATATCCATATCTATTCACTATC
ACCGATACACATAGGAATACAAATACAGAAAACGGTTATCCGAATCCTACTAAAATAATAAAATATGACGAAATAGGAGACGTTATT
ATACACAGACGCGAAGCCATGTTATACAATGTAAATCGTATGACCAACAAATTATAGGATATTTGACTACAGATCTGGATATTTTAT
TCTAATATCTTATAAGATGTAGATACTTTGTATCCATATTCGTACTCATATACCCGCAAAATCCTGTAAGTTGGATGCGTGTCCTTA
TCGGATCTGGATTCATATTATTGACCATCCGAACTTAATAAGCGCAAGTTATTGGCCTCGGAATCCATCATACATAAATTGGTAATT
TGTAAAACAAATAGGAAGAAGGTGAACAGGCTGTTGTGGGCCCAACGTATGCTGTTCCTTTGAGGAAGCCCACCAACCCAATAGAAA
TGTAGCAAGTAAAGAAAACTGGAGCCCACTTAAGGTTGTTAACAGCCCAGAAGCGAAGTTGACCCGAATCATTTGCAGGTGTGCTAA
TGTTCTGGAATTATGAAACATTCTTTGAGATGACAGAGTAGAAAATTGCCTTCTGGTTGGCTGCATGTTTTTATACGGCAAAAGAAC
CAGCACCGAAGGATACGGCACCCACTTTTCCACCCACAAGACCTATATAAAAATTTATAAGGAGTTAGATTGAGACTTATTACTGAA

Fig. 13AJ

ATTTCACAATTCAAAGTTGGTGAGGGCATTAATTCCAATCTCATTTATACTGATATAAAATTCGATCAATATCGGTATTTACTATTT
GCAATGGTCTAAAATTCATAGCAAGTGTTAAGATACATAATTCATTTTATTCCTTTCCTATATGTTTGAAAAAAATCATAGGAAGCA
TGAAAGTAATAAAATAGGATTTTTTTATTATATTGATTTAGAATCTATTACTAGATAGTTTTCTCCTCCTTGTATACGACTTCCTAT
TGAGCGCCCTCTACTAGATTTCTGTTAGCTTGACTCAGTCATGGTGACCAAATCAACGATTCTCAGTAGAGAGAATTGTGGAACGTG
AAAACGTGGAACAGTTGTTGAGAGAAAATCTCTCATTGGGGCGGATCTTCGGGGGGTGGAGTTAGTGGTTCATCCCCTATAAATGG
AGGAGTAATTCTCCTTGAGAAATCACAACGAAGAAGGTGAAAAACCTCTTACCCATTAGCGGAACCCCTCTCAATATCTGTTCTTCC
TTCTTCTCTGAGTTCAAATACTGGTATCAGAGCACGTCGATCTCATCGCCGCCCCCTTGGAGCTCTGCGTCAATCGGCCACCTCGAC
GACTCTCCTGCCGACGATCGATCGACGACGACGACGACAACTCGACGACCCTTGCTGCTTCGATCGACAACGACGATGATCGACGATG
ACAACAAATCCGCGCCGATCTCAACTCAGTCGTCTCCATCCTCGGCGATTAACAGAGACATCAGCCGCCCCTTGCAATTTTACGGCG
TAACCCTAGCTCCCAGCTCGAGATCATTTTTTAACAGCTTCAGTAGGGCACGAGTGGGGCACTCGTTTTCTCAAGAGCCGAGTTACA
AAGCCAGGCCCAATTACCACAACCAGCAAAGCCCATCCACTTTATTCGTTTAATCAAAGCCAAACCATTTCATTTTTTTTGAATCAA
AGTCAGGCCCATTCAACCTCACGTTTTAGAAACTAAGGCCACTTCTCTCTATAAAAAAATATCACTTTAGTCCTTTACAATTCAATA
TTCTGTTTTCAATCATTTTGGGTTGTTCGAACAATTCTTCGCAATTTCTATTCGGTGTAACTCCACAACAGCAGCAGATTATCTCCA
AATCCAGTCAGAAACGACGCCAAAACTTCGATAAGAGATTCTTCGGTCAACACCGCTAAGCGACAATCTCGCTCAAATTGGAGCCTC
TTTCATCAACTCGGAACAATCAGGTTCATTTTTATTTAATTAATTAATTTATTTTAACTTTATTATTATTTAGTATTATTGTCAAAA
TATCAACCTTATACAAATATTTAAAATTGAATTTAGTTTTAGTTCTTTACCGAATGGCTAGTAAACTCGTTCTATCAGAACTAGGCA
AAATTGACAAATTTAATGGCAGTAATTATGATATATGGCATAGAAAAATAGGATATGCTCTTATTCATGACAACATTGATGATATAA
TCAAAACCACTGCTCCAATCCTTACTGATAAATCTACACCTGAAGAAAACAAAGGGTTTGAACAGTGGAAGTCGAAAGATAAAAAGG
CGAAAAGTCTTATGCTCATGTTCATGGAAGATAACTTAATCAAAGTTTTTGAAACTTATAAGACTTCCATGGACATGTGGAATGCAA
TAAAAAAAATACGACACTGCTTCTGAAGTTAACATTCAACTCCTCTTGCATAAGTATAATTCTTGTCGTATGCAAGAGGGAGACAAT
GTCGTAGAGTATATAAATAAAATGATTGTCATGGCTAAGGACTTATCCACTGCTGGACCGAAATCCTGAAAAGAATGCAAGTGGCA
ACCATTTTGAATAGTCTTCCCCCTTCACTTGTTGTGCCTGCCACCACATTAAGAATGAATCCTGCCATTAAGTCTGTCACTGATCTT
CCTATGCACCTAGCGATAGAACAGAACTTAATAGCCAGTAGGAAGGAACCAGAACTGAATATGGTATAGCAGCAGCTGAGTTATGTC
CGCCAGATGCATAATACCGGAAGCTATAAAAACCCTGGTTCTAGTAAACCACAACCACGAGGATCGAAATAGCAGTAGTTCAAGAGA
AAAAAAGTACCCCGCAGAGCCTGTTACAATTGTGGAAAGTTCGGGCATTTCAAACCCAATTGCCCACAAGGTGAAAAGCAGGAGAAT
AAGGGAGGCTATAAGCATCCAGAACAAGGGGGGACTACCAAAAGAGAATTCGTCGGAGTGGTTGGTGGATCGACCCCGGTGCGACTA
GGCATATCGCAAAGGACAAGAATGGAGTCGTAGAATTCACCGAGCTGAAGAAAGGAGAACATAGAATCTATATGGGAAATAATACCT
ATCTCGATGTAGAAGGTATTGGTTCGTATAGATTGGATCTTGGGGACAACATTCTTGTCCTCAAAGATGTGTTCTATACGCCAGGAA
TTCGACGCAATCTGATCTCTGTTTCAGCTTGATGAAGAAAGGACTGGAAGTGAGGTTCTATAATAACAGGGTTTCTATAGGCAAGAA
TAATAAAGTGTATGCTATGGGTAAATATGTGCCCGAGCATGAATTATGCATTCTTCCAGTAGTTTGTAATAATTCTGATAATAAAAT
TTCGAATTTGAACTACTTGTCTTATTATATTTCTAAATCTGAATTGTGGCATTCTAGACTAGGACATGCTAGTATTTCAAAAATAAA
AGAAATTATCAAAATGAACTTGCTTCCTGTACTATCTAATGTTCAATTGCCACCATGTGAACATTGTTTAACTGGTAAAATGACTAG
AAAACCTTTTGTTGGCGGACATAGAGCCAATGAACTTTTAGGGTTGATACACTCGGATATTTGTGGTCCCTTAAGTGTCAAAACTCA
TAGTAATAAAGAATATTTTATTACTTTTATAGATGATTATTCCAAGTTTGCACACGTCTATCTTATATCCAGAAAATTAGAAGCTTT
TGACTGTTTTAAGAGATATAAGACAGAAGTTGAAAACCAACTTGGATTGAAAATCAAAATTTTGAGAACTGATAGAGGTGAGAAATA
TAACTCTAAAGAATTTGAGAGTTATTGTATTCAGCATGGAATTAAAAGGCATACAACAATGCCATATACGCCACAACAGAATGGTGT
TGCTGAAAGAAAAAACAGAACATTACTTAATGTAGTTAGATGCATGTTGTCTCATTCTGGTCTCTCTAAAAACTTTTGGGGAGAAGC
ATTGTTAACTGCAAACTACATTTTAAATAGAATTCCCATCAAAGTAGTAGTATCTGCACCTTATGAATTATGGAATGGGAAGAAACC
TAATTTGAGTCATCTCAGGAAGTAGGGATCTATAGCCCATGTTCCCATTCCATGTCAACTTAGAGATAAGTTGGATTTTAAAATAAT
AAAGTGTAGATTCATAGGATATTCAGAAAAGTCAAAAGGTTATAAGTTCTATAATAAAGAAAAAGGAGTCATTGAAAGCAGAGATGC
TACATTTCTAGAGAATCTAGAGGAAGAGGAACAAGTTCGAGAGGAAACATAACCTCTAACTGTAATAGATGATGATTATTACAGTGT
TGTTCCTACTAATGACTCTGATATTGTGAATGAACCTAACCTTGAAAATAATGAAATACCTATGGAAAATAATGTACCTAATCAACC
GGTTGTAGGCAACAAAAGGGCAAGAACACAACCTTCATGGATGGATGATTACTATTTGTATTCATGTGGGCCATCCTATTTCTCGGT
AGATACAAATGTAGAAGAACAATATCTCTTAACCTTTTCTGATGCGATGAAATCGCATGAATCAACTTTATGGCTAGAATCTATGAG
AGAAGAACTTGATTCTATAGAAAAGAATAAGGTATGGGAGTTATGTGATCTACTAGAAAATAGAAAAGCCATAGGATGCAAATGGGT
GCTCAAAAAGAAATATCGTATTGATGGATCTATTGATAAATTCAAAGCACGGTTAGTTGCCAAAGGTTATAACCAGAAGCCAGGAAT
AGATTTTCAGGAGACGTATTCTCCTGTAGCTAAATTTGCATCTATTAGAATTATTTTGGCTATTGTTGCATATTTTGATTTGGAGTT
ATTCCAAATGGATGTTAAAACTGTATTCCTTAACGGAGAGTTGAAGGAAGCAATATACATGCAACAACCTGAAGGTTTTCAGGTGAA
AGAATAGGAACATAAAGTTTACAAATTAATGAAATCTCTATATGGTTTAAAATAGTCTTCTAGACAATGGTATCTCAAATTTCATGA
TGCAGTTACTAAACTTGGTTTATTCAAAATAAATTAGATAATTGTGTATATGTCTTGAAAAGTGGAGCAAGTTTACTATATTGTC
ATTATATGTGGATGATATATTGCTCGTTGGAAATGATATAGAAATGTTGAATAAAATCAAGACAGATCTCAGCGAAAAGTTTGAGAT
GAAAGACATGGGAGATGCATCATATATTCTTGGAATTCAAATAATTCGAGATAGAAAGCCTAGAATGCTAAGTTTAAACCAAGAAAA
ATATTTAAGATCAGTTCTTAAAAGGTTTGGAATGCAGAATTCCAATCCGGCACCAACTCCGTTGGTTATGGGAAAGAGATTATGTAA
AGAGCAAAGCCCTGGAGAGGGGTAGAAGCCTTTAGATGTTCCTTATGCTCAAGCAATTGGAAGCTTGATGTATGCAATGTTGTACAC
CAGACCTGATATAGCTTATGCTGTGAGTCTAGTCAGTCGATATCAAAGTAATCCAGGACCAGCACATTGAGAAGCTGTTAAAAGGAT
TATGAAGTATATTAGAAGTACATTGACTCATAGATTAGTTTATCAAGCTGAATCGCTTGAACTCCTCGGTTATTCTGATGCTGATTT
CGCAGGTGATAAAGATGATGGAAAGTCCACTTCGGGACACTTATTCATCTTTGGAGGAGGAGCTGTTTCTTGGAGTAGTAAGAAACA
AGGGTGTGTTGCTAGATATACGCAAGAAGCTGAATATATAGCTTGCAGTATGGCAACTACACATGCTGTCTGGACAAGATGATTTTT
GATTGATCTTGATCTCAATTTGTTAGAAGGACCTATTGATATTTATTGTGATAATCAAACAACAATTAGCTTAATCAATAGTGGCGC
GAATAGCTCCAAAGGAAAACATATTGAGATCCAGTATCACTATATTCGAGATATTGTAGAAAAGGGAGAAGTCAAAGTGACTTATAT

Fig. 13AK

CCCTACTATAGATATGATTGCTGATCCTTTGACAAAAGGAATACCAACGGAATCTTTTATCAAACATGTAAGTTTGATGGGACTTAG
GAATAAATAAGTCCAAGTAAAATTTCATGAATAATGAAATAAGAGTTACTCTCTACGGATAGTGGCAGTAATGATAAGCAGAAACAT
CTGATCTTACGGATAGTGGGAGGCATGTCACTTGGTTAATTTGGTCAAGTGGGAGATGTTAGCTTGACTCGGTCATGGTGACCAAAT
CAACGATTCTCAGTAGAGAGAATTGTGGAACGTGAAAACGTGGAATGGTTGTTGAGAGAAAATCTCTCATTGGGGCGGATCTTGGGG
GGTGAAGTTAGTGGGTTCAGCCCCTATAAATGGAGGAGTAATTCTCCTTGAGAAATCACAACGAAGAAGGTGAAAAACCTCTTACCC
ATTAGCGGAACCCCCGTCAATACCTGTTCTTCCTTCTTCTCTGAGATCAAATGAATTAGTAGAGGGCATTTATTCCAATCTCATTTA
TACTGATATAAAATTCGATCAATATCGGTATTTACTATTTGCAATGGTCTAAAATTCATAGCAAGTGTAAGATACATAATTCATTTT
ATTCCTTTCCTATATGTTTGAAAAAAAAGCATAGGAAGCATGAAAGTAATAAAATAGGATTTTTTTATTATATTGATTTAGAATCTA
TTACTAGATAGTTTTCTCCTCCTTCCTCCTCGTATACAACTTCCTATTGAGCGCCCTCTACTAGATTTCTTCCAGCATTCATGGTGG
GCTTATACTTCATAATGGGTTGTTTGGTTTGAAAGGATTTTTTTTGGGGGAAAAGAAGTCTTCCACGGCTTTAGGTTAAAAATAGAT
TTGAAATGAGTTAAAAATAGATTTGATCATAATACGGTGATAATTCATCTCATCTCATCTTTTTTTCTTAGTTTTAAGAAACGAACCA
AATAAAAGAAAAAAAAAACTTATTATAGAAAATATGTTTCTTATAATTAATTTCATTATTTTTTTAGCCAACCATACAAAAAATTTA
AGGAAATAGGCATCGGAAACCTCGCGCCACATCATGAAAACGAGAAATGTCATTTCTGAGATTGGACAGAAAACATGGGAAACAATA
ATAAAAAATTGCTCTACTCATTTATTATCAATCATTGATGTCTTTTTTATGATTTGGTTTTGCCAACCAAAACATTAGATTGCATAG
AAATGGTTTTCCATCCTTCATTTATCGTGAAATAAGCATTAAAAAAAATGCAATTTCCATAAAATAACTAGAAAAATATGCAAATAA
ATTTTTTGCATGAAAACCTATTTCCTACCAAAAAGGTTTTCATGCAAAAAAATGCTAAATGTACGGCGATGGTTGTACTATTCTTGT
ACTACTAGGTACAAAGAAGTATGGTCCGTAGTAACTCATTATTTTTCTTTACAATTTATATAGGAAATGATCTCAATCTTTATGGGT
GGTAGTACAAGAACAATATAATTCTTGTATTAGTAAAGTTTTTGCTACTCATTTTCCTATAATCTAGAGAAACCCACCAAAACAGGC
CCTTAGAAAGTCTTTTGAGCCTTTGAGGGCCTTTGAGGATAATATATAACCTATTGGATCCGGATCAATGACAAACCTAACCGGACC
CGATTACGGCGTACGGCAAACGCGAGCCGGTTAGCGCTCACAAAAATCGCCAAGAAAAGAACCTCTCTTAACCCCTCAGCAAACTAA
ATAATTCCAGACTTGACCCATTTCCTCACTCCAACCCCCGTTCGAATAAGCTTTCCCTCCCTCGTAAACAAATCAAAAAATTACAAA
AACCCCCCTCGATTCCCCATTCCCGCCTCAATCCCTTCCATCGCCTCTTCAAACCCTACAATTTCTCTCCCCTCCCCCTCTTCATAT
CATTGATCGAGACCCAGGGTTCGCAGAATGGATCCTCAGATCCTCGTCGCCCTCGGCCTCTCCCTTGTCGGCGGCTCAGCACCTCA
ATTGGTTCGATTCTGGGTTTGATGTCATTTTCTTAAAATTTGTAGCTTTTTTTTAAAAACCCGTTCTCAATACGTTTTTGCCCCCC
CTTTTGGTTCTTAAAAAGTTAAAAACTGATGTTTTTTATAGAGAAAGTTTTTTTTTTTTACTTGTTACAGCTAGTTGATTTGTGATCT
AGAGCAGCTTATGGAAATTATAATGTAGTTAGCTTAGAATGTTGATATAGATTTGTGGTAACCTTCGTTTTGAGGGAGATTTGCTTA
TTAACGGAATGATAGGAGAAGATTACGCAAATTTAAACAGGGTATCATTATGAATATGCATGACCTCAATTGTGTAGTGTAGGGTAG
ATTAAAATCAAAAGGAAAAAAGATACATTTTTAATAGATTTATGAGTGTGCATGACCTCAATTGATGCTTTTGCTGAATTAAGTGAT
AGCTTCATCAGCGGCCATTAAGGGCTCTATAAAATTCTTTGTAATATAAAACATTCTTTACTTCTCCTTGATGGAAATTGTTTTCTCG
GTGGAGACTGGATATGTTGGGGAAATTACCCACTAAACCAGAGAATAGAACAATCACAAACACAATATTTACGTGGTTCGATCAAAT
TGATCTACGTCCACGGCAAGAGGGTGTATCACTATATTCAATCTCAACATACAACACTCATACAAAATATTGACAGCTCACAGATTT
CTTGTGTGGCTTTCTCTCTCTTTTTCTCTCAATCACTCTCTGCTGGTTTGGAGTTTTGGAGTGCGTTTTACAGAGGAAGAGAGGGGG
GTTTTATAGCTTCCATGCCTTCTCTTTTGTCAACAAATTCGGCACCTCCTCTCTCTTGATGTCAACAACGGAGGCTGCACCTCCCCC
TCTCTCTTGATGTCAACAATTGAGGCCACCGAAAGTTTTGTTGGCCTCAATTGTTGACTAACAATGACTAACAATCTCCACCTCGGT
GAAGTTTTCCCAAAAAACTGAGCCGACACCAATAACTAGTGAGTCTTCACCCATCTTGCAAACAATGCCCCAAAAGGGGCCACTTAA
CAAGTGCGAATCCCTCCCAAATTCAAGCACTGCTTGAACTTGAAGCCCGGGATCGGTTTGGTCAACATGTCACCTGGGTTGTCTGCA
GTACCTATCTTTTTCATCGTGATGTTTCTTTCAGCAGTTGCCTCACGAATGAAATGATATCTGACATCAATATGCTTTGTCCTCTCA
TGATGTGCTGAGTTTTTGCTTAGATGTATTGCGCTCTGATTGTCGCAAAATACAACTGAACTAGCCTCCTGCTGTAGTCCAAGCTCA
CTCACGAGATTTCTCAACCAAATGGCTTCTTTTACCGCTTCTGCTGCTGCCATGTATTCTACCTCTGTGGTAGACAAAGTAACTGTC
GACTGTAGAGTCGATCTCCAACTAATAGCTGAGCCAGAAAGAGTAAAAAGATAACCAGTCAAAGATCTCCTTTTATCGAGATCACCT
GCATAGTCAGAATCCACAAAACCTACAACTGAGGTTCCCAAAGTACTGCTATCAAAAACTAAACCCAAATCTGAGGTACCCCTGAGA
TACCGAAGGATCCACTTTACTGCTTCCCAGTGTGCCTTCCCTGGTTGAGCCATGTATCTGCTCACTACACTGACTGCCTGGGCAATG
TCTGGACGAGTGCAAATCATAGCATACATTATGCTACCCACTGCATTGGAGTATGGAACTCGGGACATCTCCTTCTTCTCGTTCTCA
CTTGTAGGTGAATCTGAAGCCGAGAGCCTAAAGTGAGGAGCCAAAGGAGTCGTAACGGCTTGGCCTTCTTCATCCCAAAGCGTTCA
AGCACCTTTTCAATATAACTCTTCTGTGAGAGATATAAAGTTCCAGCTTTCCTGTCCCTCCTGATCTCCATACCTAAGATCTTCTTT
GCTGCACCAAGATCTTTCATCTCAAACTCATCACTGAGTTGTTTCTTCAAAATAAGAATCTGCCACATGTTCTTAGCAGCAATAAGC
ATCTCATCGACATATAATAGAAGATAAATAAAAGAATCATCTCCTAGATGCATGTAGTACACACAACTATCATAAGTACTTCTTGAG
TACCCATGACTAAGCATAAAATTATCAAACCTCTTGTACCACTGTCTGGGAGATTGCTTCAGCCGTACAAAGATTTCTTCAATCTG
CAAACTTGATCTTCTTTACCTTCTACGAAGTATCCCTCTGGCTGAGACATGTAGATAGTCTCCTCAAGTTCGCCATGTAAAAATGCA
GTCTTCACATCAAGCTGCTCAAGCTCCAGATCAAATAGAGCAACCATGGCAAGCAATACACGGATGGAGGTATGCTTTACAACCGGA
GAGAACACTTCATCATAGTCAATTCCCTCCTTTTGTCTATAACCCTTAGCCACCAACCGTGCTTTGAATCTAGCATCTTCAACCCCT
GGGATCCCTTCTTTCTTCTTGAAAATCCACTTGCATCCAATTGCCCTTTTACCCTTAGGTAATTGCACCAAATCCCAAGTCTGATTC
TTGTAGAGTGACTCGAGTTCTTCTGTCATAGCTGTGGCCCAACGTCCAGATTCTCCGCATGAGACAGCTTCAGTAAAGTTTGATGGC
TCTTGAATACTCATCTCTTCAGCTGTCGTGAGAGCATACGCCACTAATTCAGCATGTGCATATCTTTGAGGAGGTTTGATCTGTCTC
CTCTCTCTGCCAGTGGCTATGGAATAAGGTTCTTCAGTCTCAGCATCATCAGCATCTGAGCCTGAATCATGTTGCTCTTCTACAGCT
GTAGGAGCAAATTTTATAGACGACTTTTGAGACGTCTCTCCCTCGAGCTCCACCTGAAGCTCCACCTTATCCATGGTCTTCTCTACA
TTTCCTGTAGACTCAACAGAAACCTTCCCATGATCAAGCATATATCTTTCATTAAAAGTAACATCTCTACTAATAATGAATTTAGGA
GAATCAGGTTCAAGACTCCACAAACGATAGCCTTTAATGCCATCAGCATAACCAATAAATATGTATTTCTTAGCTCTAGGCTCAAGC
TTACCCTCTCTAACATGATAGTAAGCAGGGCATCCAAATACCTTTAAATTTGAATAGTCATTTGGTTTACCTGACCATACCTCATTT
GGAGTCTTGTGTTCAATGGCTGTAGAAGGAGACCGATTCACCAAGTAACAAGCTGTGTTAACAGCTTCAGCCCAGAAGCCTTTATCC

Fig. 13 AL

AAGCCAGAGTTTGAGAGCATACACCTAGCTCTCTCCATCAACGTTCTATTCATGCGTTCTGCCACCCCGTTTTGCTGAGGAGTGTGC
CTGACCGTGCGATGTCGTACGATCCCAGAATTTGAGCAGAACTGATTGAACTCACCACTGCAGAACTCTAAGCCATTATCTGTTCGG
AGACGTTTAATCTTCTTTCCAGTTTGATTCTCAACAAGTACTTTCCACTTCTTGAAAGTTTCGAACACCTCGCTTTTGCGCCTGAGA
AAGTAAACCCAAACTTTCCTGGAAAAATCATCAATAAACGTTAGAAAATAAAGAGCACCACCTTTGGATGGAACCTGAGCAGGTCCC
CATAAATCTGAATGGATGTAGTCGAGAGTGCCCTTCGTCGTATGTGAGCCAGTCGAGAAGCTGACCCGAGTTTGCTTCCCAAACACA
CAATGCTCACAGAAATCCAGTGATGATGTATGATCACCACAGAGTAAGCCACGTTTACTCAAAATAGTCATTCCCTTCTCACTCATG
TGGCCTAAGCGCATGTGCCACAACTGAGTAGTGTCCCTATCAGCATCAGAAGACATACCTGCAGAGCCTGTCACCGTACTGCCTTGG
AGAACATAAAGACTGTTCACCTTACTACCTTTCATCACAACCAATGAACCCTTAGTAACTCTAAGAGCTCCCCCTTCGCCAGTGTAA
GAACACCCAATAGAATCCAAAGAACTCAAAGAAATCAAATTTTTCTTTAAGTCTGGGATGTGTCTCACATCTGATAAAGTTCTCACT
ATCCCATCGTGACACCGGATGCGAACTGTACCAATGCCAACTGTCTTGCAAACTGTATTGTTGCCCATCAAAACTGATCCACCACTT
ATAGATCTGTAAGTAGTGAACCAATCTTTATTTGGACACATATGAAAAGACGCACCTGTATCCAAGATCCATTCTTTATCGGAACGG
CCATCCAAGGGACATACTGTAAGAACCGTCTCAACAACAACGACAATATTAGCCTTTGCCGTATTAGCTGAATCTGAGGTTTCACCA
CGCTGGTTGTCTTTCTTCTTTAGAGCATAACATTCTGACTTGTAATGCCCTTTCTTGTGACAGTAGAAACACTCCACATTTTTCTTG
TTTGGGGCTGACCTGGACTTTGAGCGATTTCTGGATTGCCCTTTATCACCCTCTCTGGCCTTCGATCTACCTCTGGCTAGCAGACCA
TCAGCCTGCCCATCGGTACCTCTCCCATTCAACTTTGTTCTCAACTCAGCAGAGTTCAAAGAGGCCTTCACATCCTCAAGACTTATG
GATTCTCTTCCATACAACATAGAGTTAACAAAGTTTTCATAAGAGTTAGGCAATGAACATAACACAATGAGAGCCTGGTCTTCATCA
TCAAGTTTAAGATCCAGCTTTTTCATATCCATGACAATTTTATTAAATTCATCAAGGTGTTCCTGAATGGGTGTACCTTCCTTCATC
TTCAGTGTGTATAGCCGCTGCTTCAGGTATAATCTCGTAGTAAGAGATTTCTTCAAGTAGAGACTTTCGAGCTTTGACCACAACCCC
GCTGCCGTTTCCTCATCGGCAACTTCACGAAGCACATTGTCGGATAGTGACAATTGCAAGGCGCTGTGAGCCTTTTCGTCCATCTCT
TCGATCTCGGCACTAGTCATATCTTCTGGGTATTTCCCATCGATAGCTTTAACCGTGCCTTCACGTCGCAACAAAGCCTTCATCTTT
ATCCTCCATAGGCCGAAATTATTTTGGCCATCAAAGATCGACACCGAGAACTTCACAGAAGCCATTGTGGAGGATTGAAAGCTGTCC
TAGAACCGAGAAGCTCTGATACCAGTTTGTTGGGAAATTACCCACTAAACCAGAGAATAGAACAATCACAAACACAATATTTACGT
GGTTCGATCAAATTGATCTACGTCCACGGCAAGAGGGTGTATCACTATATTCAATCTCAACATACAACACTCATACAAAATATTGAG
AGCTCACAGATTTCTTGTGTGGCTTTCTCTCTCTTTTTCTCTCAATCACTCTCTGCTGGTTTGGAGTTTTGGAGTGCGTTTTACAGA
GGAAGAGAGGGGGGTTTTATAGCTTCCATGCCTTCTCTTTTGTCAACAAATTCGGCACCTCCTCTCTCTTGATGTCAACAACGGAGG
CTGCACCTCCCCCTCTCTCTTGATGTCAACAATTGAGGCTGCACCTCCCCCTCTCTCTTGATGTCAACAATTGAGGCCACCGAAAGT
TTTGTTGGCCTCAATTGTTGACTAACAATGACTAACAGGATAGAAACTAATGATAGTTTTGTGCTTGGTTCAGGTGCACTTTTTGTG
GTTCTTACTCATACTCCCAATCTCAAATTACTTGGTCTTCTACAGGTGTTTTTTTTATTTATTTTTGATTCCCTTTTCCTGTTGCAC
TTAAGGAAGATTTCAGTTTAGATTGGTTTTTTTCTGATCAGGGTTTTGCTGCTGGCCTCATGCTGAGCATGTCATTTTTGGACTTGA
CCCATAATGCTCTGAACTCCGTTGGCTTTCTAAAGGGTAACCTTTGGGTGAGACTTATTATTATTGTTATTATTATTATTAAATTGC
TGGCAATCTAGCAGGGTCTGATATTGGAATTTAGAAGTCATCACCTTCATCTTAACGCATATTCATTCTATAACCGGTTAACTTTAT
CTAAAAAAATTATTTTATCATGCAGTTTTGTGCGGAGTTATTTCTTTTGCAATTGTTGTTACTTTTATACCTGAACCTTCACTTGT
TCCAAGAACAGATGTAGGTAACAAAAAGGTATGGACCTTCGAATGCAGTTTACCTTGATTCAGAAATATTGTACTTCTGCGTGTAGA
TTCTAGTCATGTTCCTAGTATGGATGGGCATTCAGCATATTCATTTACTTGTTTGCTTTCGTGGTAACAGGATGATGATGATGATGG
ATCAGGTAAAGCCATTATGAAGAAGCATCGCCGGCAGGTCTTATTTAGTGGAATTATCACTGCAGTTGGTAAGCATGCTCTGCTGTT
TAGAATGTATCTTTCCGTTCTCTGTATTCTAAATTCATCGACACCTAGAGTAGCAAAATTCATTTTGGAGAATTAGTCTTTAGGGTT
ATTTTTCTCTTTCTCAAGCTCCTAGTTTCATCTTTAGTCCTGTACATGACAATATTCCCACCAGAATTAGCGTGATTCTATGTGATA
TATTTGCATTATTAGGGACCAAAGGCATGATCTATCTCTAGACATGTATTGATGATTATCTGCACCTTCATCATTCTACGTCATTTA
TGATCGCAGATCAAGAATGTTGATATGGATAACTGAATTTAGATTATAATCTGAATGATGCAACTAAAAGAGTTTGATTGATACCTT
TGTATAGTTTTTACATTTTCTTAGTTCAGGATTATGATTACTCTAGTAACTTCTTCTTTATATTTTTTAGTGTATAAATTAGGACTT
GATGAATGACTTGGTTATGCAAATTCGGAAAGCTGAGCTATTTTACTCATCTGCTTAGCCTGCCATATCACAGACTACATTTGTCTG
TCAGATAACTAATGACCACCTTCTTGGTTTTATCTAATGAATTATTTTCCTTTCTATAAGTTGCAGGTATTAGTTTGCACAACTTCC
CTAAGGGAGTGGCAGTGTTCCTTGGTTCAATGAAGGTGTGGTTTTTAATTTTTCTTTTGCAAAATATGGTGTAGCAAGATTCACAGA
ATAAAGTTCCAGATACACCTGTTTGCTTTCATACATAGAGCTGTTGAATAGACCTTCTTGAGACATAGTTCTTTTCTATTTTGAATA
CGATTGGATCTTATTGTTCTTGAATCGCTGTACCTTCAATTGGATCTTATTGTTCTTGAATCGCTGTTGACTAGACCTTCGTGGTCT
CTGAGTCTCTATTCTTTGACCATCAGTCCATGAATTACCACACAATCTACCTTACCTTGTACTTATTCTGCCTGCTTTAACTGGTTA
CCGTAATATAACAAGACTTGATTGGAATTATCAGAAACGGTTTATATGAAAAAAAAATCACGAAAGTATGCTAGAGACAACATTTAA
AATTGACTTGTTATGCAATAAGGGTACATGAATAACAAGCAAACAAGATCATGGTGCACAAATAGGTGGCGTGTGCCACACATGGGT
AGGCATGCAGATTGACTCTGCATTGTTTGGAGTTGAAGTATTGCATTGGTATGCATGAGTTAGATTTGCATTCAGCGGTTGTACATA
CTTGGTTTGATGAATGAAAAATTATTATCATGAATGATGTAATAATATTGTCCTAGATGTGATAAATTGTAAACTTGGAATTGTTCA
TGGACCATTATTAACGTAGAATTGTAGACCATTATTAACGTATTACGCAATATGATAGCATTTTAAAAATGGCTTCCATTTAGGAAG
CATAAAGTGTGCTGCAGTACTGGTTGGTTATTGTATATATTCTGCACAAAGTAGTAAACAAAGTGCTCTTGATTCCAATGGTTATAC
TTTTTTTTTTAAATTTTTTACAGGAACAGGGTAAGATATGTTATCTGTAGAAATTCCTGTCATGGGTCCATCTTATAATTGTATGTG
TACTTTATTTATTAAAATTTCATTTCTGATGCTGCGTGTCCTAAATTAGGGGCTTCGTGTTGGCATTAACCTTGCTCTAGCTATTGC
ATTGCACAATATTCCAGAGGTATGTTTTCAATCTGAAACGTTCCCATATATGCAAACATAATCTGCCAACATCTGTTTCCCCCTTTA
TTATTTATTTGGAAGCTCATTTGGCGTTCAGCTATCATTAACACACTTTTTGCTCTTTTATTGAACTAATAATTCTTTTACTCTTGT
GTTATTTATTTGGAATCCTTCTCGTTTAAAAGCCACCTGTCGTTAACAGTTTTACTCTTTTATTAAGTTAGTAAATTATAATTTTCA
AACAAAAAGTTTCAAGCTTGTATTTGTGGTGTTTCTATACTTATTACTCCTGATTAGCCGCTTATTTTCATCTGTAGTTCTCATTAT
AATGATCTTTCTGTAGGGAGTTGCTATAGCCCTTCCTGTCCATTTTGCCACTCAAAGGTAAGGTTTCTAACTCCGCATGCATTTTTG
GCAGTAGACTTGAATACATTTTGGTGTCAGCTTAGACGAGAATGAGATATTGATGGTACCATTTTTTGAACAATTTGTGTTGGCGAA

Fig. 13AM

GTCCCATCTTTTTATTTCACTGTCTACTAAATGTTTTTCGCTCCTCCCTTATGTTGTTTTTCATGAGCATTTAGATCCGACTTAAAA
TAACTGCAGCAGTAACTATCTTTCTGAAAGTTATCTAATACATTTCCTTTATCGTAACATTTTTTTGGCCGCAGCAAATGGCAGGCAT
TTAAACTGGCAAGTCTTTCTGGTTTTGCCGAGCCGCTAGGTGTAATTATTGTAGGTATGTGATCGCTTACTTTTATTTATATGCTAA
TTTTGACTTACATTGACTCTCGTTGCGACTTATTTCTTGTTTCTTTCTGATATATCATGTACTGAACCGATTTTTTCTTTCCCAAAA
TCTTGGCAATAGTTCGCATAGTGTCACCTTACAATGAAAATAATTACAGAGCTTGCTGACCTATTCCATTGTGGGACACCTGCAGTT
TATCGTGTAGTTGTACTGTACTGGGTTTATTGAGTGAAAATTACAGAACACTTATCATCCTATAGACATGTATAAGCTTATTTAAGC
ACTGAAAAGATAGTTTTGAAGAAAGTCAGATAGTTTCATTCTCAACAGGTTACTTACATTAAGTTTCATATCTGGTATGCTATCATT
CAGATTATCGAATATCCTATATATATGGATTTTTCCTGTAAATTCCTATGCATTTCATTAGAAATAAAACAACATCTAGGTATCACA
TAATTGCTTTAAAAGATAGCATGGTTTTATTTCTTTGAATAATTGCAAAAAGACTTGTCTATTCTAAATGCAGCTTATCTCTTCCCA
ACCGGTCTAAGTCCTGAAATTCTTGAAGGCTTACTTGGAGCAGGTTTTTCCTCCTATTAAGCTGATCTTGTTTTATGCTCAAGTGAC
AATTTTTTTTGAGCTGCATTTTAACTGACTGATTTGTCTTTTGTACAGTCGGTGGAGTTATGGCTTTTCTCGCTTTACATGAAATGC
TTCCGGTGGCAATTGACTATGCTGGCCAAAAGCAAGCTGTGAAAGCGGTCTTTGTTGGGATGGCTTTCATGTCTGCAAGGTCGGTTC
CCAACAAGTAGAATAATTTACCTTTTCGTCGTCATTCTCATTTAACATCAAATTCTAAAGGAAGCATTTGTTTCATCTCATAACAAA
ATGCTTTTTTGCTAATGTTGCTTTGAATCAATTTCGCGTTTTGTAATTCCCCAATGAATTGGGTTGGGGTTGCATCGGTTGAGGAAT
GATTTGTATATTGATAGTAACAAAGAATGAAACTCATGGACAAGGGAAGATCTACGTTTACAGTTGTGACACTAATCCTTCTCTTGG
GTTTGGTTTTGATCTGTGTTTTTTTCATTGTCTTGGCAGCCTATACTTTGTAGAAATCAGCTTGCCAAAGGAAATGAGTGTGTAAAC
GTCCGATGGTCTATCAATTACTGTTGCAGAAACACATTCTTTGTACATTCCAGAAACTAGGCAGGTCCTTCTCTTGTCAATATATAC
AAACTGTAATCTGTATATTCGTTCAAAGGAATAAAATTGTTGGCATTACATTTCTTGTACATCTTTTTCCATAACATTTGGATATCC
TCTTACTTGAAATTGAAACTGATCTTTGTCGATCAGCCGACCCTTTTGACAAAAACAAAAGAGCACCGAAAGAGCTTACAGTTGTTG
ACAAAGGAAAATAAAACAAAAATGGCAGGCCTCACAGCATAGTAAAATATTAATATTTTATTATGCATAGTATTTTTCCAAACACTA
TAAATAGACTCCAAATCCTTAAGAAAAAACTCATCCCAGAAACAACTTCTCTTGTAGAAGAGTGGGAGAAAAGAGAGAGAGAGAGTA
TCTCCTGTTGTGCCGCAGCGGAAATTTCGGCAGAGTTTCTGGTACACAATAAGATAGAAAGATCGATGAGAATTCATGTCTCACCAAG
GAAACAAGAATCTGAAGTGAATATCTCAACAAAGTGGGATATCAGCTCTTCCTCTCATCAGTTCTAGGACTGACTTGTCGAGGGAAC
CTAATAAACTATTACAATGGTCACAAACAGCAAATCACACAAGTTTTACGTGGTTCGGCAAATGGAAATGGAATACAAATAGGTTTA
CAACCACTAAAGATCTCATAAATAAACCCTCAATCTAATCTCTCAATTCCTCTCTCAAAATCAGCACTAGAGACTGCACAAAACTCT
TACAAAAGCCGCCTCTTTTCTTCTCTGCCGAAAAGAAACTCAAAGCCGAAAACCAAATTCTCCTTTCACTCCGCCCGAAGCCAAAGA
AGCCGTCTGCAGTTTTATTTCTCCTCTTGCACATGAAACCCTAGAAAGAACACGCTATATATAGCATCAAATGACATTCGGGTGGGC
CTGTCAAAATCTCACTGCTGTTCACGTGCTCCTCAACGTGATCTTATGACGAGTTGAGAAAACGCGTCATTCACACAAAATTCGTGG
CCCCCACGAGTCATGTCACGTCTTCGTTCGTTCACAGCCCCATGTCGTCTCGTCCTTATCATTTCACGCGTTCATAATTCTCCACCT
CGGTGAAGTTTTCCCAAAACTGAGCCGACACCAACTAAACCAAAATGTCTCACTTGTTACGTCCAGTATGAAGTGAAACAATTCACA
ACAACAGACTCAATCTACAACAAGTCGAGAACCCAAACGAGAATGCGAACAAACTCCAAATCTCGGTATCAACTCAGCAAACCGGCT
GTATCATAAATGACTGCCTACGTATCCTCTTGCCCAAGGAATCAAGCCTTCACGTAGTTCATCCAATGGCCTCCAAAGGGCTACGTA
TCCTCTTGCCCAAGGAATCAAGCCTTCACGTAGTTCATCCAATGGCCTCCAAAGGCCCTCAAACAAATAGAAAAGTCTGCAACTTAA
TCAAGCCTTCACGTAGTTCATCCAATGGCCTCCAAAGGCCCTCAAACAAATAGAAAAGTCTGCAACTTTTCCCCAATATCACCAACG
GATCTGCAACTGATAGCGCTCCCAATGGCCCCAAACTGAAATGAATCAAACACCTCCATCTGAGGTGAACCAATGACCGTATCTAAA
TCATGTCCACCGGCTGCAACCGAATCCAAAAACAATCCATCATCTGCATCCAAATCCAAAAGATCCCCAAACTGTGTCACTTCAGCT
AGAATCCCAAATGATGCAGTATGATCTAGAGTATGTGGAGTAATCTCCACCTAATGTGAAGTAGCATCACTCTTCACCCGCTGCGAT
ACATCTAAGGTCTGTCCAAAACTCTCCACCTACTGAGAGTCAAATAGCTCCCTTGTCGAAGCCTCAACCGAAGTGACACTACCAGAC
CAAACACCCAATTGAGTTTTACCTCCTATCACAGCAGTTGACAACTCTTTAATAAGATGGTACAAATATGTCGAAGCCTCAGTCCAG
AAACTCTTCTGCAGACCATTGCTTGACAACAAACATTGATCCTCCTCCAGCAAGGCACGGTTCTCCAAATTTGCCACCCTATCTAGT
TGCCCCAAGATTTTCTTTCCAACGAAGTGTCTCGAAATGCCGTGAGCTCGGGTCCAATACAGAAATAGGTCCATCTTGTACCTCCTA
TCAAAATCAAAATGAAGTACCTCCACTTTTCTGTCTATCACACACTTCTTCAATTTGTTAGAGATTATTGGGACTTTCTCCAATGGG
GATTTGGTTGCAACCCAAACACGCCTAGAGCATTCACCAACAAAGGAAACCAAACGCCTATTACCTCCCAATGATGCCCCCTTGAAA
GGCCCCCAAACATCCACATGAACTCCTCTAGAATGACCCTTAACACGGTGAATAGAGGTGCCAAACTTCACCTCGGTCTTCTTGCCC
ACATCAACATGTTCACTGGACTTCAAGCTGCAGGTCTTGGCACCCTCTTTCAATCTATGCAAGGAATCAATACTAGAATGACCAAGC
CCCAAATACCATAGTCTAGTCAAATCAACAGAAGTCGCCAGCTCTCCACCTGTCACTATACCTCCAGTCAAGTAATACATGTTATTC
CTCCTGACGCCCTTCATCACAATCTGAGAGTCTTCCACGATCTCGAGAACCATGTCCTCAACACGAACCTTCAGACTCTCTCCAACC
AAAGCTCCAATCGAGATCAAGTTCTTCCTCAAGGAAGGAACATATCTCACATCATATAACTCCCTAACAGTCCCGTCAAACATCTTG
ATACGAATTCTTCCTATCCCAAGGATCTGACATGCACGGTTATCAACCATGTACACCACACCACTATCCAGCTTTTCAAAACTAGAG
AACCATTTCCTTCTAGGGCACACATGATAGGTCGCATCACTATCCAACATCCATTCAGATTCCTCTGAATAGCTATCTGTAGGACTG
ATAGAAAGTGAATAAATAGAAAAGTCAGAAATATTACCATCCGATATAACAATATTTGCTTCTGATAATGGTTGCTTTCCTTTTCCC
TTCTGCTTATTCTTCATCCATTCGTCGAGCTTTGGATAGTCTTTCTTCCAATGATCAGTCTCCTTGCACCAAGCACACTGATCTTTT
CTAATTGTAGGATGTCCTACTCTAGACTGTAACTTTTAATTCTTCCGGTTTGGATTCTTCCCTCTTACGATCAATGCTTCTGTTACC
GGCTCAACTGAAGCCTCCTTATCCTTCTTTCGAAGCTGATAATTTATAAGTGCAGCGGTGACCTTACTATACGAAAGAGATCCCTTC
CCATTAATAAGAGTAAAGACGAAGGTCTTAAATTCCTCGTCAGGCAAGGAACTCAACAGCAACAACGCCTTGTCCTTATCTTCAATC
ATAACATCCACATTCGCCAAATCCGCAAGAAGCTTCGTGTAGTGATTCATGTGATCTCTAATTGAGGTTCCCTTCTTCAACTGGAAA
CGATAAAGTCTCCTCTTCAAATGCAAGCAATTCTCAATACTCTTTGTCAGATACTTGCTTTCGAGAATCTCCCAAATCTTCCTCGCA
GAAATATCATTCATGTAGGCTGTCTAAAAATCATAATAGATAGCTTATCCCTCATCAAACACCGATGATGGAAGTTACAATCTGACG
ACTTCCAGAAGGCTACAATTTGAAGACTTTCACGTAGATCGCTGAAGGTTACAATCTGACGACCTTCACGACAACCGATGAGAGCTC
TAGTTCAACAGCATTCACAATCAACATCGGGAGTTACAATCTGACGACTCTCATATTCTCAAGGAGCCAAGACGAAGATTACAAGAC

Fig. 13AN

AATGATCTTTACAACGCTATGACAAAAGAGACTGCTTTGTGATAATCTCTTCAAGACAAGACGCGGAGGTCCTCCCCGTGTGTCAAC
ATCAAAATGCCGGGGTCGAACACGCGTTACAACATCAAAACGCGAGGGTCGAACCCACGTTACAACATCAAAACGCCAGGGTCAAAC
CCGCGTTACAACATCAAAACGCTGGAGTCGGACCCGCGTTACAACAAGCGAAACGTGAGCGACCCTCGCGTTCTGGATGTTCAGTCA
ACACCCAACCTCGCGTCTCAATCCTAAGACGCGAGGTTACGATCCTGAACGCCAACGTGGCGTTTGACTCATTCAAATATGAGTCG
AACGGTTTCAGAACCATTTTCCCCACGATCTGAGGAAATCACGCCCACTTAGGAGCGGAGTTAGAGGGCAGTTACACCCCCTTAATC
CCCTATAAAAGCGAGTAAACTCAACTGAGTTAAGGTGGGATTTTTCTTGGCTTGAATCGACCATTGAGGGCTGGCTTTTTGGAACG
GAANNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNN
TACATACAAAAGATGGCGACTCCGCTGGGGACTAGCTTTTCTGACGAAGAAGTGGTGGCGCAGTCCGACGTCCACCTCATGGGAACA
ACTGTTAAAACTCTCGTCGTAGAGTTTGACCAAGCAAAATACGAGGAAGTCCTCTCCTCCGGATCGCTTAGCCCCAAGGCCAAGCGT
GGTGTCCGCAAGATCTCCAAGGAGGTCAAATCTGTTGTTGAAACGTCAAAGAAAGTTCTCTCCTTTGGCCAAAATTCGTCGAACAGC
CCCTCCGCTCCAGGAGCGGGCTCGGCCTCTGCTGAACTCACACAGCGAGTTGAATATCCCACCTCCGCGTCAGCACGACGTGCTACA
GGCCATAAACGGCCTATAGAGGAGACCAGCTCCATAAACGTCAACGACGTTGCTGCAAAAGCCTTGAAACAGGCCAAGAAGAACGCT
GCTCGTCGAAGAAGAAGGTCTCACCGACGAGCACAACTTCAAAAAAATCGATCCTCCAACCAACGCGAGATTCGCGTTCGCGAGCCT
GAACGCGACCCTGAGCGAGCCCAAACATGAGCTTCGCGAGAACCACACTGAACATGGCCCTCAATGGCGCGTTTACAGCCAAAATG
CGAACCTCGAGCCTTCGTTGAACGTGAACTTTAACTTCGCGTTTCCAAGTCAAAACACGACCTTCGTGTCGACGCTAAAGAACGCGA
CCCTCATGTCGCCAAACCAAAATGCGACCCTCGCGTTTCAGGTGCCAAACGCGACCTTCGCGTTTCAAGTGCCAAACGCGACCCTCG
CGTCCCAAGTTCCAAATCCAATACCGCGAATACTCTGCGTAGCGCGACTAGATTGAGGGGCAGATATAAGAAGTTTATGGATTCAAG
GCATCTCAACCAGTCATGGATTCAAGTCATCTCAACCAGATCCATGTTTACCAAGAGCCAGTCCTGTCCAATCATGGACTGGGGGTT
CCAATTCAAACCTCACAATCAGTGAGTAATTCTCCTCAAATCTTTACAACAGATTTGAGAGAGTTCACATCGAGAGTAAGACCGATG
CAACAAGTCATTCGTTCATTCCAACGTGAACGACTGATTCCTACGGTCCTCTCGGGATGTCAATGTTGTTCATATTTGAGAGAGTTC
ATATCGAGAGAAAGACCGATGCAGCAAGTCATTCGTTCATTCCAATGTGAACGGCTGATTCCTATGGTCCTCTCGGGATATCAATGC
TGCTCATATGCGGCCAAACCATTGGTGTTCGACCAATTAACGGACGTTGCTTTGTCTAACCAACGACGACATTCGCACAGGAAGAAG
TCTCCAGAGACCGAATATCCTGAGGTCACTATCAATGTGATCGGCAGAGGGAAAGCCTCAGGTCCTAGTTCCGATGACTCTGAGACA
AGTCGTTCACCGACCGTCAGAGAAATTGCTAACGAGTTTGAAGGAGTTTACCNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNG
AGAGGAAAAGCGTCTTCATCCCGACTTCACACAAGAAAAGGGAAGGAAAAAGTGGTTGATAACGCTGCTTCTGACCAAGAAGCCCAT
AACCTGGAATCTTCCTCTGATGAAGGAAGAGAGACTGAGAACGAGTATAATCTCCAGTCTGCCAAAATGGAAGAATTGGAAGACCGC
CTCAATGCCATGGCCAACAAAAGCGAGCTCCAAGACGAGGGAGTTGTCAGACCCTATCCTGCCGAATGGGATGCAGCCCCTTATCCT
CTAAAATTTGAAGTCCCGACGTTACAAGCTTTTGACGGCACGGGATCACCGAACCAACATATCTATCATTTCAAGTCACAGACTGGG
AATGTGATATCAAACGACGCCATACTAGCTCGATTGTTCATTGGCACCCTCAAGGGAGTTGCCTTTGAATGGTTCAGGAAACTGCCT
GCAGGATGTATCCAAAAGTGAGCAGATTTAGAGAGACTCTTCCTGTCAAGATTTTTTGAAGAGGATACAGAAGTCTCCATCCATATC
CTTCTCGCCACTAAGCAGAAGAAGAGGGAGTCCGTCAAAGCCTTCGTCAAGAGGTTCCGAACCATGGCTCTCCGGTGTTCGTCAGGT
ATGACACAGTCTACCTTAGTAGAGACCTGTCGATACAACCTGCAGACCAACATCCTAGCTCGAATAGGGGTTGCAGAATGCCGTTCC
TGGAGATAACTGATCTCTCAAGACGAACAGGCTCAAAAGATTATTGCCAGGATCATAGCTGAAGAACAAAGTAGGCAAGATCAACCT
GAGCAATCGGACCAAGCCCAACCTTCTCCTGAGCAATCGGACCAAGCCCAATCTCCTCAGTCAGAAGGGGAAGATACTACGACCACT
GAAGCTAATCCTCTTCAGTAGGATGCCGGGTCTCCAATAACTATCACGTTAACAATTACCTCTGATAGTCAAACTCGCTAGATAATG
ACTCACTAGGCGATGTGTCATGTCTTCTCTTTTCCCCCTGCACTTGTTCAAGACTGGGGGTTGGTTTATTGGTAGTTTATTGGATTA
TGAGTAATAAATTTTCTGAGTTGTTATGTTTAATAGAATACATTTGTCAACCAAAAAATCTACCAGAACTATCACGACCATCAACTT
GTCAATCCGCTTCAATAGGATGACAGGTCCACTAAAACTATCACGTTAATGATCACCTCTGATAGTCTGTTTTCTCCAAATTTCCCC
ACCAATCCTCTTCAAGTAGGATGACGGGTCTATCAAAACTATCATGTTAATGGTTACCTCTGATAGTCCATTCCCTCCAAATTCTCT
TGTCAATCCTCTTCAAGTAGGATGGCGGGTTCACAAAAAACTATCACGTTAACAGTTACCTCTGATAGTCAAACTCATCAGATAATG
GCCTACCAGGTGATGTGCCTCTATTCTGACTTCATGGATAGTGCCTCACTAAGCGATGTGCCTTGTCTACCTCTTTTTTATTCCCCT
GCTAAGTCTTAATCAAGACTGGGGGTTGGTTACTTGGGATCCATTGGATTAAGAGTAACGAATCTTTCACATTGTCGAGTTAACATT
ACACTTCTGACGATCATCATCCCCACAGAGTATGCATTCAACTTGCATCACTCCTAATTTGTCACGTTAACAATATACCTCTGACAA
CAATCAACTTATCAATCCTTGACAATAAGATTATAAGTTCTCAAAATTGCTCAAATCGCAATCTTCCCCAGCAAGACGCTAAGTCTT
CAAAATCTTGTTCAAATCACAAGCATCAAAATTTATCGCTTTTGATGATAAACTCATTTAGCAAGTTTCCCCAGCGAGACGCTAATT
CCTAAAATCTTGTGCAAGTCACAAGAACACATTCCTGTCACGTTAACAATATACATCTGACAACAATCCACTTATCAATCCTCGTCA
ATAGGATGATAAGTCTCCAAAGTTGCTCCAATTGCAACACAAACTCTCGTCACGTTAACACTAAACCTCTGACAACCCACTTATCAA
TCCTCTTCAATAGGATGATAAGTCCACAAAGTTGCTCCAATCGCAACATCCTCCTGTCACGTTAACACTAAACCTCTGACAAATTCA
CTTATCAATCCTCTCCAATAGGATGGATAAGTCCACAAACTTGCTCCAATCGCAACATTAAACCTCTGACAAATCAACTTGTCAATC
CTCTTCAATAGGATGATGAGTCCACAAAGTTGCTCCAATCGCAACACAAATCATGTCATGTTAACATTAAACCTCTGATAATCTACT
TATCAATCCTCGTCAATAGGATGATAAGTCCACAAAGTTACTCCAATCGCAATATTTCTCCTGTCACGTTAAAATCACACCTCTGAC
AAATTCACTTATCAATCCTCGTCAATAGGATGATAAGTCCACAAAGTTACTCCAATCGCAACACAAATCTTGTCACGTTAATACCAA
ACACCTCTGACAAAATCCACTTATCGACTCTCCCCAATAGAACGATAAGTCCACAAAATTGCCCTGATCGCAATATCTTTCCCGTCA
AGTTAACATCACACCTCTGACGACACAATCCACTTATCGACTCTCCTCAATAGAGCGATAGGTCCTCAAATTCCAGTCAAGTTAACA
TCATACCTCTGACAACACAAATCAACTTATCGACTCTTTTCAATTGAGCGATAGGTCCATAAAATACTGTTAGGTTAACATCACATC

Fig. 13AO

TCTAACAGTCAAACCCCCCAAATGAACTTGTTAATTCTTTTTTCAACAAAAATAGCAAGTTTTTATTATAAAATCCCCAGCGGATTA
AAGATTTTCTGGAATTATCCTAGTGATAACAAAGAAAATTTCTGAATTTCACTCTTAGTGAAAATTCATGCCAAGTTAATACTACAT
CTCTGGCGTTTTCAATTTTCTTTTAGTGTTTCAAGTAAAAATATAACACAGGAATAAATAGTGACAAAGCCTACGTATTCAACATCG
TAACGCCAAAATCCATGCCTCACATGCATGGGGAATTTTATCCTGAATCCTAAGTAGGGATAAGTCAACGCCTAACACGCGTTGCCG
GTTAGTCTTTCACCATAAAAAAGGACAAAAGTCTACGTATTCAATATCGTAGCAGGTTGTTATTAATAACGCCAAAATTCATGCCTT
ACACGCATGGCGAACTTTGTCCCAAATCCTAAGTAGGGATAAGCCTACGCCTAACACGCGTTGCCGGTTAGTCTTTTTTCGTGAAAA
TGACAAAGTCTATGTATTCAAAATCATAGCATCAAGCCTAAGAGAGTTCATTCTCTTAGCACAACGTTACATGTGGAACGGACTTAG
ACAATCCACATGCTAGCCCGACTCAAACGGTAGTCGGTAAAGGCTTATCAAATCCGTTGATGGCTGAGGGTTTGCCAAAAATCCTAT
GTATGTTTGAAGGCCCATCAGCTTAATGGACGTGAGCCGAGACTTGAAACTGATAAGCTAAAGACAAGTCTCAAAGATTTAGTCAAA
AATACACGGAAGCCACTTCCATGTCTCAAGTTCAAAACGCCGAGGTCAGACCCGCGTTACAAAAATCACGACGCCGAGGTCACACCC
GGGTTCCAAATTCAAAACGCCGAAGTCAGCCCCGCGTCTCAAGTCCAAAATGTAGGGTCCACCCCCGCATTCCAGAAGCAGGATTAT
GACGCATACCTTCATACAGGTCCTACATAGCAAATCCCTTCAACCAAGATACCTTCGAAGCGAGTGCAGAGAACGACTCTTTTACGA
TAAGGAATCAACAGCTCCAAGATCAGAGTTGAGATCCAAAGTATTCCGAAAATTCGTCCCAGTCAACCATGAACTTTCGAAAACTTT
GGAGGGAGTTCTGTAGGCTGTCTAAAAATTATAATAGATAGCTTATCCCCCATCAAACACCGATGATGGAAGTTATAATCTGACGAC
TTCCAGAAGGCTATAATTTGAAGACTTTCACGTAGATCGCTGAACGTTACAATCTGACGACCTTCACGACAACCGATGAGAGTTCTA
GTTCAACAGCATTCACAATCAATATCGGGAGTTATAATCTGACGACTCTCATATTCTCAAGGAGCCAAGCAAAGATTACAAAATAAC
GATCTTTGCAACGCTTTGACAGAAAGAGACTACAAATCGANNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNN
NTTGCTTTCGAGAATCTCCCAAATCTTCTTCGCAGAAGTCTCATTCATCACATCATATTTTAGATCTTGAGTCAAACAAGACCTAAT
CATGCCACACTCCGTTCGATTCATCTTCTTCCAAACATTCTCTTCAATCTCATCTGGCTTCCCATCTAACTTCAAGGTATCCTCCAA
ATTCTGCGCGTTCAGCGCATCCAAAACCTCGCATCTCCATAATCTAAAGTTGTTTGTGCTATTAAATTTCTCCACATCTATCTTCAT
AGAGTGGATATTCAAACTCTGAATGGTCTTTGCGCCAGAAGCACCACCCTCGACACCCGAAGCACCTTCTTTCCCCGACATCTTACG
CACCAACGAACAAAGAATAGACCCAAAACTGAATCTCAATGCACCAACGAACGAAGAATAGATCCAAAACTAAAAAGATACAGTCTT
TACCAAAAGATCCCACCTTTATCCCCAAACAAAGCCCTAGACGAGCTTCCAAAGCGACCTACTCCTCCAAATAGTCCAAGCATAGCC
CGAGCTCTGATACCACTTGTTGTGCACAACGAAAATTTCGGCAGAGTTTCTGGTGCACAATAAGAGAGAAAGATCGATAAGAATTCC
TGTCTCACCAAGAAAACAAGAATCTGAAGCGAATATCTCAACAAAGTGGGATATCAGCTCTTCCTCTCATCAGTTCTAGGACTAATT
TGTCGAGGGAACCTAATAAACTATTACAATAACCACAAATAACAAATCACATAAGTTTTACGTGGTTCGACAAATTGCCTACGTCCA
CGGGGCAAGGAGGGGGGGGGGTCTACAATTAGAGGGAAAGGGAATACAAATAGGTTTACAACCACTCAAGATCTCACAAATAAACC
CTCAATCTAATCTCTCAATTCCTCTCTCAAAATCAGCACGAGAGACTGCACAAAACTCTCACAAAAGCCGCCTCTTTTCTTCTCCGT
CGAAAAGAAACTCACAGCCGAAAACCAAATTCTCCTTTCACTCCGCCCGAAGCCAAAGAAGCCGTCTGCAGTTTTATTTCTCCTCTT
GCACACGAAACCCTAGAAAGAACACGCTATATATAGCATCAAATGACATTCGGGTGGGCCTGTCAAAATCTCGCTGTTGTTCACGTG
CTCCTCAACGTGATCTCATCACGAGTTGAGAAAACGCGTCATTCACACAAAATTCGTGGCTCCCACGAGTCACGTCACGTCTTCGTT
CGTTCACAACCCCATGTCATCTCATCCTTATCATTTCACGCGTTCACATCTCATTGTTAAGAGAGATTGTAACTCCAGAGTTTTCTC
CTCATAGTAAATTTTTCTATCCTTGCCCGTGGACGTAGGCAATCAAGTGCCGAACCACGTAAATCTGTGTGTCTATCATTTTATCTC
TACTTTTGCTCGCTGCGACCATGCTCTATTGGGCCCCAGGTTGGCCCTAACGATCTTAGCATTACTATGTTGGAATACAACCTGTAT
TTGACAATGTTGGTTATGAACTGATGACATCGTGGAGGACAACAATGAACGATATATTATGCAGGAACATTGTATTTGTGAGGGACA
GAGACTTACGTTTGTGAAAAGAATCACACTATATAACTAGCCACTCTAAAGTGTTATTTTCATCATTTAAGCAGAAGAGATGGCGAT
CTATAACTTACACTGTTAGGTGCTAAGGTCAGTTATCATTGTATGGTTCTCCATTCCCTGCAAAGTTTAGGTGGTACAAGGAGTGTA
TCAATCAATAAAGAAGATAGTTTCACAAAAGGATTGAGCAATTTCACGTGGACAGATTGTTAATCTATCACACCTACTCATTCAGTC
ATCAGATCAAGAAAATGATGCAAATGTAGGCATTGTTCGAGAGTGCTGATGTTGATTTAGCATGCGATACACGTGAAAACTAAAGGT
CAAGAATCATCTGCATTTTGATAAGGATCGATCTCCTCTTAAATTATGGAAGGTCTGTTCTAGTGATTTGAAATCTTTCTTAATGAC
TTCTGCGCACAAACCTACTCCTATATATATGCTTGCACTTGGAGATGAACCGTCCTTAAAGTTTCTGCAGTCCTTCTCTTACTTTAC
AAGCTGGATAAAGATGTTTCCGATTGGATTCTTCCAGATTCAGTGGTGGATATGGGAGATCAAGGCAATTCTAAGGTATGGAGCTTA
CATTGATGCATCTCTCCATTATCTCTCCATACTCTTCTTCTGCTGAATTATATCTTTGATATAAGATACTAAAGATTGTCAAATTAA
AGTAAAATGAGGGAGGGGAAGTCTTTCATCATCTTAGGGGGGAATGAATCAGTAAACTTTATCGAGCTTTATAGGGAAGCGAATTG
ATCTTCGTTAACATTTACATCACAGCCTATATGCACTAGGTTATGGACCATTCAAGTAACTGAAACTAAAGCCATTACCACAAGCCT
ATATGCACTAGGTTATGCACTAGGTTATGGACCATTCAAAATCTTTGTCAAACATAAGTGGGGTGAGAATACCCACCATTTGAGGGA
TTAAAATTCCAAAATATGACCACTTGAGGCACGAATTTGAAAATGTTTAACGAATTGATAGGTGGTAATTTGCAAAATTTATAAAGA
TTTGAGGCACTAATTATGAAGATGTAACTCCTCGTTTGGTACGCGGGAATGAGGTGGAATGGAATGGTCATTCTCACTTCTCATTCA
CTGATACCAAACGTACCTATTTTTTAGAGGTTGGAATGACCATTCCCACCTTTTGTGGGAATGAGCATTTCAAGTGAATTGATAAGG
AATGATCATTCCCATTCAAGTGAGAATCAAATTAGTTACGTAATTTTCAATTATACCCTCATTGATAATAAAAATAAACCAAAAAA
TCTCATCTCATTGACTACGTATATCATTTTTCTATTTCGAAACTTATTATTTTAGTTGGTGTTGTTTTATGGATTTTTTTTTATGAT
ATGGGTGATTTTGATACTTCATCAAATGAGTTAATTTATATATCTAGAACTGTGGATTGTGGATATCATTTTTTATATTATTTTTGA
ACCTATGAAAGATGCGATACTCTTTTATTTATTTTTCTTTAATTTTTTAAGACTAAGAAATAGTGAGTATTGTTTAAAAAATATAAA
CGGAACATACACCTGAGAGATAACATGTGCATTAGTATAACAAATAGCTAGATTAATATAACCTATGCATAAATAAAATTGTTTAGT

Fig. 13AP

TATTATCATTAATGCTTATTTTTATCTTATTAAAAATCTATGTTGTTGTAAGGGCATTATTAGAAAATAAAATTTCATTCTCACTTG
TGAACTAGTGATACCAAACATGGGAATGAGAGTGAGATTTTTATTCTAGCTTCATTCTACAAACGCACCCAAACAAGAGAATGGGAA
TGACCATTCCATTCACACATACATTCCATTCCATTCATTCTTCTATTCCATTCTCATTTGAGTCTATACCCGCATACCAAACGTAGG
CGCTTATAACTTTACTATAAATTGCTTAAAAACTATTATAAAGGTAGTATTTGTTAAACTTAGTCTACAAATCCCCAACACTTTGTA
GAGTTTCCTATAAAACCCGCAAAACCATCTTATTTTCAAACTACACGTGAAATCTTCAAAGTTTCAATTTTATCAATTTGTCCTCTA
AATCTTTTGAAAAACCGTTGGTTAACTCCTCAGCTTAACTTCCTTGTTTGCAATAAAAAAAACCTTTTTGTTTTTCAATTTTTCTCT
ATGCTGGAGGCGATTTTTTTCATTTGGTTGGAGAATAATGAATAATTGAGGTTTTAAAACGCATTATACACCTGAGCCAAGTGAAGG
CTTCTCATGGGTCTGGATCTTTTCCGCTATAGATTGAAGCTAATCCCAGTTATTACACAAATCCACAGAATATAATTTTCTTTTTC
CTTTGTTTCTTGAACTCAGATCTCGTATCCTGGAAAAATTGATTATGAGCATTTGGAAATCGAGTATACGTTTGAATCAATATCTGA
TTAGTTATAGATATTTAAATAGCCACATCCACACATATATTTCATATATGGTTATGGATACAAATACCATCTAATCTTTCATAGGAT
AAAAACATGGATATAGATAAAAATATAGGAATCCAGATGCAGATACTTGTATATCTATGATTACATCAAATTCTTTTGATCTTATAT
TTGTGGATCTGAAACCAATTTGCATAACTTATAGTTTGCTGTTATGGTGAAAAAAATTGGTGAATTATGATTCGGATATTTTATTTA
TTTAGACAATTTATATTATCAGTTTCTCTCATTTGAGACATGCAACTGATATTCACTACCCAGAAAAAAACTTATGGCTAAACATTA
CGAGGACCAAAATCAATTTAAAGCAGATACATAGATAAGATTGTTTACATTTAAGAAGAAGAAAAATTTTATTTATACAGAACAGTT
GCATCGTTAGAATGCACCCCAAAGAAATTGCTTTAGAGAAAGTTATCTATTACACTTTGGCATCTAATAGGCTTCATATCAGAATAC
CCCCCGTAACTTTGGGAGATTATCAGAAAACTCCCCTTAACTTTCAAAATAAAAGAAACCCCCTTAAGTTTAGGGGTTATCAGAAAA
CCGCCTTTAACTTTAAGCTTTATCACAAACCCCCTAACAACATCACCCGAAATATCCCAAATTATCGGCGAACAAAAGTACCACGC
GAAGGGATTTTTAATGGGAGAGTTTTTTTTTTCAAGAACTCATATAGTTTTTTCAGCAAGAAGTCAAATCAATGTGTTAAACTAAAT
TTAAAAAAATTTCTTATCACGCGAGGGGAAATCCCTACCCCGAGTATTTTGTTTTGCTGAAAATTTGGGATAATAAGGGATAACCG
ATGGTAGGGTTTTGTGATAAAGGGGTTTTCTGAAAATGCCTAAACTTAAGGGGAGTTTTCTGATATGTTAAAAACTCAGGGGTGT
TTTCTGATAATTTCCCAAAGTTAAGGTGGGGTTTTCTGATATTAAGCCTATCTAATACATCATAACACGTTGCTGTTGAATCCACAT
ATTCTCTGAGAAACAACAGTACTTGATATACTAACTTAGCACATTTAAAACACCTGTAGTTGTTTTCTCCACTCCCTTCCCGTAGTA
GGAAGAACAAAAAACACCATTTCTCAAACTATAAGCTCCATAATTTACCAAGCCATGTGAATTCAATCATAATTAGTATCACTATCA
TCTGAAATAATGTAATTTGAAAAGAGACACGAAACGGAACATCTATAACACCAAAACCCATTTTTATATGTAATCAAGAGTTGGTTC
TGGTGCCCCATCTTGCCAATGCAAAGGGAAGCCTTCAAGCTTTTTTTCATGAGTGGCATTGAAACAAAACCCACGTAGCAAGAAATG
AACTGGTAAACAAGGTTCTCAGAATATTTTGACTTGGACCAGGCGCAACTAAGTCAAGTTACATGGGAGCTTAAAATCGATTATATA
CAACTTGATCTCGGGCTAAAGTTCTCAGAAAAACAGTGTTGTGCTTTGATACCAATTGTCGCGCGCCTATGCGGAAGCGTGCTCGCT
CACCAAACAAGTCGTAAGCACGGGAGAAGAATAACCAATCACACATGAGCACAATCCAAATACGACAAATCAAACCAAACACAGAGA
TATACGTGGTTCGGCAATTTGCCTACGTCCACAGGGACAGGATGAAGAGATTCCACTAAATCATGGAGAGTACAAAGGGTTACAATC
TCACAAAACTCACAAACTAACCCTCAACCAAAGCTCCACTAAATCATGGAGAGTACAAAGGGTTACAATCTCACAAAACTCACAAAC
TAACCCTCAACCAAAGCTCTCAACTTGCTCACAATATCTCCCTCTCACAATGCTCAAAAGTCTCTCTAATCTATGATTACAACTCTC
CTCTTTTTGATTGATCCTAATCTCTTCTAAGGCGTTCCATATATATAGAAAACCTAAAACCAAAACAGACTAGGAATTCTAAAATCA
AAAACAAAACAAATTAGGAATCCTAATAACCTATTACCAAAACAGATTAAGAATCATGTTACCAAAATAGATTAGGAATCCTAATAA
CCTCATGTTACCAAAATAGATTAGGAATCCTAATAACCTATTACCAAAACAAATTAGGAACCTGCTATCCAACAATTCTCCACCTCG
ACGAAGTATTCCCAAAACTGAGCCGACACCAACATGAACACCAATGCGTCGTCTCACCAAATTCGGCTGCACCAATGTGGTTGCCTA
CGTACCCACTCTCCCAAGGGATCAAGCCGCCGTAGTTCATCCAAATGGCCGTCAACGGCCTCAACAATCACGAATGTGCAACAAGCT
TCTACAATGATCAAACTTGTTGCTCGGAACCACCTTAGCGAGCATATCCGCCAGATTATCCTTCGTGTGGACCTTCACAATCTCCAC
ATCGTCATCTTTAAGAGCATCTCGAACGAAGTGATAACGAACGTTAATGTGCTTCGTCCTCGCATAAAAAACCTGATTCTTCACCAA
ATAGATAGCATTCATACTATCATAATGAATAGTGATGGACCGCTGCGATATACCAAGTTCCTCCAAAAATCCTCAAAGCCAAATAGC
CTCCTTCACAGCCTCTGTTATCGCCATATACTCTGCCTCCGTCATAGACAAAGCCACTGTAGACTGTAAGGTGCATCTCCAACACAC
CGGCACACGGGTCAAAGTGAACACATATCCCGTCGTAGACCGACGCTTATCCAAATCTCCGGCATAATCCAAGTCAACATAGCCAAT
GCACAATTGCCTACCTGTAGTGTCCCGCTCATAAATCAAACCAACATTGAGCGTACCTTGAATGTACCTCAAAATCCATCTCACGAC
GTCCCAATGACCCACTCCTGGATCGTGCATGTATCTCGAAACCATTCTCATCGCCTGTGACAAATCTGGCCTCGTACATACCATCGA
GTACATCAAGCTCCCAACCGCGCTCGCATATGGAGTTTTCGACATCAACTCTTTATCTTCAACTGTCTTTGGTGAAAGGTCAGCTGA
AAGTTTCAAATGGGCTCCCAAAGGTACCCTAACTGGCTTCGTATCTATGCTGATATGAAATCGCTGTAGAACCTTCTTCAAATAAGC
CACCTGTGTCAAACAAATTCTGCCCTTCTTCTTGTATCTGTCGATCTCCATCCCTAAAGTACGCTTCGCCTCACCCAAATCCTTCAT
CTCAAACTCATTTGAAAGATGTGCCTTCAACTCATCTATAACAAGATCTGGAAATAGAGGCAACCAACATGTCATTAACATAGAGCA
AAAAATAGATGTACGCACCTCCTTTCAACTTGTGAAAATACACGTAAGGATCAAACTGGCTCTGAATGTACGAATGACCAAGCATAA
AATCATCGAATCGCCTATACCACTGTCGAGAAGACTTTTTCAAAACGTATAGCGATTTCTTCAATCTGTAAACCAATTTATCCTTCC
CTGCAGCTCGGAATCCCAATGGCTGAGTCATATATATTTTTTTATCAAGATCACCATGAAGAAATATCATCTTTATATCTAACTGAT
CTAACTCCAAACCATACTGTGCCACCAAAGCTAGCAAAATCCGAATCGAAGAGTGCTCCACCAAAGCTAGCAAAATCCGAATCGAAG
AGTGCTTCACCACCAGAGAGAGAAAACCTCATTATAGTCAATACCTTCCTCCTGTGCAAATCCGAATCGAAGAGTGCTTCACCACCAGA
GAGAAAACCTCATTATAGTCAATACCTTCCTCCTGTGCGTAGCCCTTCGCAACCAACCTAGATTTGAACCTCAATGGAGTGCCCTCA
ATGCCCACCTTCTTTGTGTATACCCACTTGCAACCAATTGCCTTCCGCCCCTTTGGAAGCTTAATAAGCTCCCATGTATCATTCTTG
TGAAGAGACTCTATCTCCTCTTGCATAGCTACCTGCCACAAATCAGCCTCCGAACTCTGCTCGGCCTCTCTGAATGTGGTAGGCACC
ATCTCATCGATACTCTCCACAGGAAGTGTATACGTAACCGTGTCGGCATACCGTGATGGCATCCATATATCTCTCCTCTGTCTCCGA
ACCGCAATAGAATCCTGAACCTGAGCTGTCGGTCCCTGATCCTACACAACTGTACTCGTATCCTCCTCGTCGCCGCTATGCTCGCCT
GGCGTCACCTCAGCCGGTACTCTAATAGATACTGTACCATCTGGACAATGTGGAGTGTAGGTGTCAAAAATTGCTTATAGATCATTG
TACGTAGCTCAAGACAGAGAGAAGGTGATAAACGTCATCATCTAAGTTGCAGATGATCATCCAAAGCTAAAGATCAACTAAAGAATA
CACAAGAAGCATATCACACAAGTTTCAAGGCACAAAATGAGCTTGTAGATTCCGAGACAATTACAACTGTCTTAAAAACTATGAAGA

Fig. 13AQ

AGCCAACGCGCTTTCGAGATAGTTGTAACTGTCTCAGACACTGTGAAGAAGCCAACATACTTCCGAGACAGTTATAACTATCTCGGA
AACATGGAGGGACTCGACCACTTCCGAGACACTTACAATTGTCTCGGAAGCATAAAGCAACTGACCACTTTCGAGACACTCACAACT
ATCTCAGAAGCTAAGAGGAGAGAATGACAGTTTTCTTGAGATTTGTGCGTACTATGTGACTCCATAACTGCCAAAGATCTGTTTGAA
CGTGGAGGAGTAGTTACAAGCGGGAATCACGCCCACAACCGCTGGAATCATGACATTAAAACGTGAGAAAAGCAGTTACAAAATGGC
AGAAGCGGACCACGCTTCCGAGACAGTCACAACTGTCTCAGAAATGGGAAGCTGACCACGTTTCCGAGATAGCTTTTTGAGACAGTT
GTAACTATCTCGGAAATAGGAAGCTCATCCTGCTTCTGAGACAGTTACAACTGTCTCGGAAATAGAAGTTCCCTGATGTGACTTCTT
TTCAACTTTCATCTTTAGTTACAGTTCCTAAAGGCTATAAATACCCCCCTAGGACCATTACTGACGAGGAGCCAAGCAGAGAGAGCA
AATTAAGCAGAGAACTTGAGCATTTTGGAGCGTTCTTCTCAAGAGAGAGAGAGTCTTCATCAAATTCGAGTGCAAACAGCAACTTTG
AGATTCCTTAAGATCTAAGCTTCGACTTGATCTTGAGAAGAGTGTTCATCTTACATCGATAAGATATTCACTTAACTTTTTCTTACT
TCTAAACGAAGCAAGAATTCTAAATTACCTTCACGATTCAATCAGAATCTGTGAATCGGTGGTCCACGAGCTAATGCACCCCCGACA
CAGGTAAAGATCCCGGCAAGCAGTGATCCAAACAATGATCCTGCGTGTGTTTCTAAGGAGCTTGTAATTTGATTTTTATTGTAAAG
AGTAGTTTTATAAAGTACGAAGCTTACTCTTCTGTATTCATTGTAATCGATAAACAATTATAATGAATTCTATAACAGAACTTGTTC
CTAATGCAAACACACTGGCGACCACAGTGGGAGCCAATGGTCTCGCTATCGAGACCGTCGTGTCGCAGCCGATTATCAAGATCCCGG
TTGAATCCATGGTCGAATACGAGTTCGACTAAGCAAAATTTGAGGAATATCTGTCGTCCTCATCCGTAAAGTCTTCATCGCCTCGCA
AATGCAGGAAAATTTTGTCTTCTAAGAAGGTTTTCAAGTTTTTTACTCTATCGAATACCACGAGTGAAGACTCTTGCCCGATTATTG
CTGAAGATTCTACTCATAACACCTCTGCTCACAATAACTCTTCTCCAATTAAGGAGTCATTGAATCAAAACCTACCGGCACTGACTA
AGAGGGATCGTCAGAGACAACGTCAACGCCGCGCTCGTCAAATGGCTAAGTCCTTAGAACAAACCGACGGGGTTCATTACTATGCGG
ACTTAGAGTCAAGGAAACATCAAGTGGTCCAGTCGCCTCAACAATAAACCACTCACATCTCTACTATACTTACGACGGAGGAATGGA
CTCTCGTCAAAAGGGCTCGTTTAATCCTTAAAGAACATATGTAAAAGCGTCGTGCAAATGCCGCTCATGCCCGTGCCCTTCGTCAAC
AAACACAAGAAGGGAAGAAGGAAATAATGTCTAAAGAATCACCAAAGAACCTCAAAGTTTGGATCCCAAAATCCGAACTTGTGCAAA
AATCAAATCACCAGAATACATCCTTCATCCAAGACACTTACAATTGTCTCGGACAAAGCAGCAGTATCCGAGACACTTGCAACTGTC
TCGGACAAAGAGGTCATATCCGAGACACTTGCAAGTGTCTCGGACAAGGGAGCTATACCCGAGACAGTTGTAACTGTCTCGGCCAAA
GAAAGGCTTCCAAGGCCTCTCCTTCGACGCCGTCGACATCCATTCCGGGTCCGTCTACTACATCCACATCTGCTATGTCACCAGTGA
AACCGTGGGTCAGTCTCGACCTGTCAAAATTCAAGATCATAATGGAGGATCGCCTCGGCCATTTATCGGATAATCAAGTTAAAGCCC
TGGTTAAGGAATGCTTGGGTTCAGTGAACGAACCCCGAATAAACTCTTACGCTGGGGGTCGTAAATGTTCTCCTATCAGGCAAAGC
AATCCCAGAAAGAGAAAATTCCAATTTCCTCTCGTTTGGGGCTTGTAAAGATTCCATGCTCGCATGGGGGTGGATCTAAACATATAA
TCTTGGATCGCTCAGAGGTGACGACAAGTCATCCTGGGTATGCCAACAAGGTTCAAACACAAAAATAGAAGATAGGTTACTCTAGTC
ACCATACTGACGAGCTGTACTATCAAACTAACGGTGGAAACAAATCATGAAAAGGACTGTTCGAGAAACAAGCCCTCATTGTGTATG
TGAAAAGCTTATCAAAGCAGTGTTATCTGAATGCAGCTGCTCTAAAGTCGAACCGCCAAGGGTTTCTGTATTCCAGAGACTTTCTGC
TAAAACGTCAAAGCCCAGGCCGAGGCATTTATGCAAAAGAATATCTGTCGTTCAACATAATAAACTTCTAGAGGTCACCATCAATAT
GACCGACAGAGGAAATCGACATTCAATCAATCCTGATCATGATTTTTCTCCGGGGGGGAGGGGGGGGGAGTTGATCAGGGCCTCTCT
CAAAGAATGTCACGACTACAGCGAAGGACCACTAGATGTAGAGATTATAGAAGAATGCATGAAGAGTTGTCTTCAGATGAGGAACTC
TCAGATACTTGTTCTGCAGTTACCTCTGATGATACAATGTCCAGTATAGGACAAGCCAGGGAATCATTCACAATTACACCTGATCAA
TTAGCCCAGATATTGCAAGAAGCTTTAGCTAAGCAACGAGAAGAAATTAGAGCTGAAATAAAAACGGAGATGGAGTTGACGATGCAA
CAGATGAGGGATTTGTAGGCCTAACAACATCTACAACAACCGGAATCAAACCAAAAGGCTGATTCTAGCAGGCGTAATACTATACCT
GTTCGGATAACTGAGGTTGATAGTGACCAAGATGTGGATGAGACCAACATTGCTGATCCTCCTCCTACTAAAGATAATTTTGAAGGT
GGTCTAGTCAAATCCGTCTATCTAACCTTCTTAAACTCACCCTAAAAAGAATATGGATGAAGACAAGAAAATGCAGGACCTTGAGAAC
AAAGTCAATGCCCTGATGATGGCTCAAGAAGTAAAGAAAACGGGCATTCCATGCCCATATCCGAGAGAGTCGGACTCAATTCCTTAT
CCCCCAAAATTCAGTTTAATTAACTTTACTCCTTTTGATGGCAGGGATTCACCCACTCAACATTTGATTTATTTCAAGTCCCATCTT
GGTGCAATATTCAGAGAGGAGGCTTTGATGGTCCGGTCATTCGTAGGGACCCTTCGTGGGCCTGCCTTCGATTGGTACCGACGTCTT
AAGCCTGGAAGTATCAACAGTTAGGATGATATGGAAGGATTGTTTCTTACCAATTTCTTCGATGATGACACTGAGGCCTCAATTGGT
ACTTTGTTGGATGAGAAACAGAAAGATGGAGAAACTGTAGATGTCTTCGTTAAACGGTTCCGAAACAAAGCGGTAAATTGCCGAGAT
CCGCTCACCGAAGAATTTATCCTCCAGACATGTCACAACAATCTTTCTTTGGATGTCCTAGAAGTCATGGGAGTTGTGCTTTCTAAG
ACTTGGAAAGGATTAAAACTATGGGGTGAACAGGCCGAATGCTTTCTCAAGAGGAAGAAGCTTGAGAGAGGTCAGCCACTAACTAAT
CCTCAAAAGCAGAATTATAATCCTCGAGGTAAAGGAAAGGGAGTCACAAGTGCTGTTGATGCTCACCAAACGTCGCAACAACCACAA
CAACAACAACAGTCACCTTTTCAACTATCACAACAGACTCAACAGTCGCCGAAACACCCAAAGACTTCAGAACCTAGATTCCCAAAA
GAATACTCTTTCAGGGACGATGAAGTACCGGTTATTTTCAAATATCTTTTAGACAACAACAAGATTAAACTTCCACCGGTCACGAAT
CAGGAAGAAGCTAAGAAGACTACAGACCCGAAATATTGTGCATATCACTATTTTTGTCGGAAATTGTTTTCATTATGGAATCCATTA
AAAACTTCAGTCGCTTACAATGAATTACACAACAAAATTAAGAAAGTTACAACTTCCTGGAAAATAACATAGAAATTGTTTATCAAC
TCCTGCTTTTGTGAGATCTTTGCCTGTGCCGGGGGTGCGTTAGCCTATGGACCACCAAATCACGAATTTTGATTGAATCATAAAGGC
TTTGGGGATTCTTCCTTCGTTTAGAAGCAAGAATAGAGTCAGTGAATATCTTATTAAAGTAAGATAAACACTCTTCTCAAGATCAAG
TCAAAGCTTAGATCTTAAAGAACCTCCCAATTGTTGAAAGGAGATGAACTCTTGAAATTCGCCAAGCCTTTTGAAAATCTCTGACCA
ATTGCTCCAGTAATAGCCTCTCTGTTCTATGCTCTCTGTGCCTGGATTCTTCTCCCAAAAAAAAGTGATCCCAGGGGGGTATTTATA
GCCCCTAAAAATTGTAACTGAAATAGAACATCATAGGGGAATTGTGCTTCCGAGACAGTCCTGACTGTCTCGGCGGTCGAGACAGT
TATGACTGTCTNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNCGAGATAGTTATGACTGTCTCGGCTTCCGAGACAGCC
CTGACTGTCTCAGAACGCCTGAGCTGCCCAATAGTTTTTTTGTAACCGCTCTCCCACGTTTTAATACCATTATTTGGTAGTTATTG
ACGTGATTTTCGCTCGCAACGTCTCCCACGTTCTTTGACAATTAATCGTCACGTGTCATGTACATGTCTTGGCAACTTCCGAACTCC
TCAGAACTATCTCGGACCGTGAGATAGTCCACACTGTCTCGCGATGCGAGACAGTCCACACTGTCTTGGGTTTTCCGAGACAATTTA

Fig. 13AR

GAGCGACTATTGTGTTCTTTTGATCTTTGAGCGTTCGTATTCATCGTTCGTATTTGTAAAATGATCCGTAAGCCATTTTTAGATGCC
TACAGATACCCCCTCCAAAGTATCACAGACTCATTCTTTTAATAGAGGAGTCTGGGACACTTTGAATAAGACATGTCTTATTTGCAA
TCCCTCAGTACTTAGTTGAGGAGATCGTGTAGAAGGACCTGTGAACGGCTTCAACTATTGACTTCTTCATCTTTTAGTCTACTTAGT
GCTTTGTAGAATAGCTAAAATTCTTTCGGTACTGCATTTATCGCTTGATCGTTGTCGAAATCTTAAACTGAGGCTGGTGTTTCATTT
TGTAANNNNNNNNNNTGAACCGATGTTGAACTGATTGTCTTTGTCGGGAATTCATATCTGGATCGCAATTGAATCCCCTGGAATCAT
CCATTAACTTGGAATTTTTCCTTAGCCTTATTTTGGCAAAAATCATTGACGCGTTGATCGGCGTTAACATAGTTTATCCTCATTCGT
TTACTAGAGTCTACACAGTTTAAGCTCTTGTAGGCTGTCTAAAAATCACAATGGATAGCTGATCCCCATCAAGCTCCAACAATGAAA
GTTATAATCAGATAGCTTTCATGCCAACAAACGAAAGCTGCAAATGGAGGACTTTTCACATAGAGCGAGAAGAGTTACAAATCAACG
ACACTTCCGAGAACTGATAAAAACTCTATTCAGCAGTCTTCACAATTTACAGTGAAAGTTACAATCTGACGACTTTCACACCCCACA
ACAGCTAATGTGAGGATTACTGAACAATGGTCCTTGCAACGCTCTACAGAAGAAGTTACAAATCAATTAGCCTCTTCTAAAACGCGG
AACTCATCTTCGCGTTACGATTCTTGAAATGCAGGCGACCCCCGCGTTTCCAAACTGTAACAAGCAAAACACGAGTGGCCCTCGTGT
TTTTGACGTTCAGTCAACACCCAACCTTGCGTCTTAATTCTAAGACGCGAAGTTAGGGTTCTGAACGCCAAATTGGCATTTGACTC
ATTCAAATATGAGTCGAACGGTTTCAGAACCGTTTTCCCCATGATCTGAGGAAATCACGCCCACTTAGGAGCGGATTTAGAGGGCAG
TTATAACCTCTTATCCACCTATAAAAACTCAACAAACTCAACCGAGTAAGGGGTTGGCTGATAGATTAGATTTTGAGCATCTAAACC
GCACAATGAGGTTTGGAGCTTGGGATTTTTCTCTGGAGATAGCAAAGGCGAATTCTTCAAAACAGAAGATTTAACTCAGATTCAGAG
GATCAAATCTAAAAGAATCCTTCAGCAACAGAAAATCTGCTTGGCCATTAACCGAATTTTCGGTTCTAACAACTCTTTTCACAGAAT
TCTAACTCGTTCTGAGTTCAAAAACTCGTTAAGAGTTATTCATTAAACTTTCCACAGAAGTTCATTGTTCCCACAAGATAAAAGATG
GTCGGATCGTCAATGGAGAGCAAATTCAACGCAAGCAATCGAAGGAGGCACTCCATCGCTACCAAGAAGAACCCAGTTTTAAACAAA
GGGGAGAATCAAATTCATTCTCCTCTCTTTTGTAATCAGGAAAACCAAATTATAATCGATTTTGAGAGAATACAAGTTAATTTTCTT
TCACTGTCTTTTTACTACAAATTTTCTACAAACAAAAGATGACGACTCTGCTGGGGACTAGCTTTTCTAACGAGGAAGTGGTGGCGT
AATCCGATGTTCACCTCATGGGAATAACTGTTGAAACTCTTGTCGTGGAGTTTGACCAAGCAAAGTACGAGGAAGCCCTCTCCTCTG
GATCGCTTAGCCCCAAGGCTAGGCGCGACGTCCGCAAGATCTCCAAGGAGATCAAACCTGTTACTGAAACGCCAAAGAAAGTCCTCT
CCTTTGGCCAAAATTTGTTGAACAGCCCCTCCACTTTAGGAGCGGGCTTAGCCTCTGCTGATCTTGTCCAGCGAGTTGAATGTCCCA
CATCCGCGTCAACACGATGCGCTTCAGGCCATAAACGACCTATAGAGGAGACGAGCTCCATAAACGCCAACGACGTTGCTGCCAAGG
CTTTGAAACAAGCCAAAAAGAACGCCGCTCGAAGACGGAAAAGATCCATACGGCGAGCACACCTGCGCGAAAGCCGAACACTGGCCT
AACGCGAAGATCACGTTCTTGAGGCTCAGCCCGAGTGCAGCGTTTCCACTCCAGAACGTGTACTTCGTGATAATGAGCCCAATTACG
AGCCTCGACTGATACAGCTGAAATGCGACCCTCAGTGATGCGTTATTTCTTCAAAACACAGCCCTCAGAAAGGCGCTGCCGAAGATA
AACGCACACCTCACATGTGCGTTCAAATGAAACATGACCCTCAAAGGTCCGTTTCACCAACTAAACACGATCCTCAGGGGTGCGTTC
AACCAAAACAGGACCCTCGAGGGCCTGTCTCATCATTTAAACATAGGCCTCATCCTAATGTTTACAAATCCAAACGCGACCCTCGCG
TTATTCCTCAGGAACGCGACCCTCGCGTTATTCCTCAGGAACGCGACCCTCGCATTGTTTCTCAAGAACGCGATCTTCAAGAGGTCC
ACCAAGTTCGGAAAAGTCAACCTGGGTTTAAAATCCACGTTCGACCAGAATCAATCTTACCCACTCAAGGACAGGGGTTCCATCTC
CGTCCCCATGCTCAGGGAGAGATTCCTCCCAAGTTCCTGATTTGCGGGAATTATTGTCAAGGGGAAAACCAGCGTAGCAAGCAGCTC
ACTCATGCCAATATGAGCGGCTTATCTCGGCAGTCCTTTCAGAATGCCATTATTGCGCATCCGTACCTCGGCAGTCCGTGTTCAACA
GGTTGACGAACATTGTTAGACCTGCCAAACAACAACGTCGATACAAAAAGAAGACAGCCGAAACTGAATACCCCGAAGTCACTATAA
ATGTGATAGGTAGAGGGAAGGCTTCAGGTCCCAGTTCTGACGAGTCACAAAGAAGTCATTCACCGACTGTTCGGGAAATTTGTGACG
AGTTCGAAGGAGTGTACAGGCATACTCGGACTCGAACAGGAACCATTCGCTCGGTTAACTACCAAAGATTAGCCAAGGGGATCGTTT
CTGATGATGAACATTTGGCAATTGCCGAATCTCAATCTTCAAGCTCTGTTGTGGCACGAGAGGTTTTCGCTTACATGGTAGGAAATC
CTGAAGACCTAGCTAAGAGAGTAGACGAACATCATGTCATGCTCCAAGCACAGCAAGAAACACTTCTGCAAATGAAGGACATGTTGG
CCCAGCTCCTTATTGAAAAAGGCTAAAAACCTGAATCTTCCCGAAGGACAATGTCAAAGGGAAAGCAGAAGGCACAAGAACATTCGG
ATTGTGAAACTCACAACTTGGAATCCTCTTCTGAAAATGAGAAGGAGATAGAAAGAGAATTGCATCCTCAGTCCGCTAAAGTGGACG
AACTGGAGGCTCGCCTCAACGCAATAGCCAACAGAAGCGAGCTCCGCGAAGAAGGAGTGGTGCGGCCTTATCCTGCTGAGTGGGACA
CAGCTCCTTACCCACCAAAGTTTAAGGCCCCTACCTTGCAACCGTTTGATGGCACATGATCGCCAAATCAGCACATCTACTATTTCA
AATCACAGACTGGAGACGTGATAGCAAATGATGCCATCCTGACGCGCTTGTTCATAGGCGCTCTTAAAGGAGTCGCCTTCGAATGGT
TTATGAAGCTGCATGCTGGATCTATTCAGAAATGGGTAGATTTAGAAAGGCTTTTCTTAGCTAGGTTCTTCGAGGACGATACAGAAG
TTTTGGTCCTGACTCTTCTCGCTGTTAGACCCTAGAGGGGGGGGGTGATTAGGGTCTTATGCTAATCTAATCTGATTAAATGCCAA
TTAAGATTAATTAACAAGTTATCCTAGCAAGTATAAAATACAATAATGTATATGAGCTAGGATAAGCAATATGAACAACAAGATATA
TCCTAACAAAGAGATATAGGCAATGTATGTGCAAGGATATATAAACAACACAAGGTAAACAATCTAAACAAGATAGGATTTGACCC
CGTCTCTCACCACACACTTCTCTCGGTGTACAAGTGTATTACAAGTGAATCCTCACAATTAGGCACAATATGACAAATGATTGTTCT
CTCTAACAAGGTGAGAACTCAATTAAGCACAACTCTTAGTCACAAACCCACAACCCCAAATTATACTATGAATGTAAATACAATAAG
CTCAATAGGTTGTGTGTGAACAAAGAGATAAAACAATATAAACTCAATATGAAATCTAGCTTATGAAATTAAGAACAAACTTATAAA
ATGCTAGAATTGAGTTTAAGGAAACTTCTCTATAGATGACAAGAGACAGGGAGAAGAATGAATGCTCAAACACCAAGGATGATCTCC
ACTTGCTCTTGTGAAATTTGCTCCACAAATCAAACTTTTGTAAATGCTTAAAAGCTTTTTAAACAAACACCAAACCCTTAAACAAAA
CTTGTAAAAACCTCTTAAAAACTTTTCTCTTGTTAGGTGGGAGAGGTAAATGCAATGGGGTATTTATAACAACCCAAGACATCAGCC
AAAACCCCTAACAAAAGATAAAAACAACTCGGTCGACCGATGAGAGCAAATAGCCGTTGGAGTGCAACGGATCTATTGTCGGTCGAC
CGGAAATTCTGTCGGTCGACCGATGGAGCTCTTGGTCGACCGCACCAGTCGACCGACCATCTCTCTGCTGCATGGTGGCGAAAGAAC
AAATGATCGGTCGATCGGTGCGGTCGACCGAAAACTGACACAGTAAAAAACTAATATGCTGATTTAAAACACTGTTTAAAAATATCA
AATAAATTCCAAAAAATGTAAAACTTTGGGGAATGATTGTAGACATGATAATAAACATGCTACAGTGACTGGTTATCAGAAAGGACC
TCCCAAAAGAAAAATATCATCATTTTACAAAATAGTCCAAAACATGAAAATATGAGATACTTGAATTTTGATGTTTTGACATAAACC
AACTTTTGAAACTTTGTAAAATGTTTTTATAGACTTAGTAAAACATGTATAAACTGATATTAAAGTCTACAAACTAAGAATACAATA
TTTTCACAAAATTGCATATTCTATGCAATGTTTTCAAAAACACAATAGAAAATATAAAATATATAATTTCATATATATAATCATAAA

Fig. 13AS

AACTCAAAACACATGTATGTATATATATAACTATATATATGCATAGAAACCAAAACTTATATATATATATATGACTATATATATATA
TACGAAGAAACCAATAAATGTGTGTGTATAGATATTGAGCTTAGAGTATATAACACACATAATATAAATCCTAAACTAAATTACCCA
AGCTAGATCTTGATCTTCAATAAGCTCTTCTAGGTAATCTCGCGGATGAAGCTTTAACTTGGATCTTGAACTTTGAATAGCAAGGCT
TCACCGACATTCCGCCAACCTCCTTTGGATATGATCGTTGAAGCTCTATTCCATCCAATATATATATATATATATATATATATACGAAG
AAACCAATAAATGTGTGTGTATAGATATTGAGCTTAGAGTATATAACACACATAATATAAAATCTAAAACTACATTACCCAAGCAAT
CTTGATCTTCAATTAAGCTTGACTTGGTACACTTGCGGATGAAGCTTGAACTTAATCTTTAACTTGAATTGTACGTTGCTTCACTCC
ACAATTCCGCCAACCTCCTCTTGATATGATCGTGTAGGCTCAATCCATCCAACCTCCAACTCGTTGTTTGCCTAGAATAAATACAAA
AACACAAACACAAACACTAGACAAACAACATTAGTAATAAATTATTTGTTAAACATCATTAAAACAAGAAGCCCAACACTCGCCAAC
AAGCAGAGGAAGAGAGAATCTATCAAGACCTATCTGGAGAGATTCCGCAGCATGGCATTGCGATGCCCTTCAGGTATGACTCAATCA
ACTTTGGTTGAAACTTACAGGCACAACTTGCAGACCCAGCTCCTTGCTTAGATAGGAGTAGTGGAGTGTCGCTCCTGGAGACAACTG
GTTTCGCAAGGAGAACAAGCTGAAGAAATCGTTGCTCGAGTTAAAGCTGAAGAAGTGACGCAACCCAAGCCACAGCAGCAACGCAAT
CAACACAATGCCCAGCGGTCTAAGGGAAAATAGACTTTTGTGGCTGACACCAGCACGCGAGCACCACCTCCCGCTAAGCAAGGCAAG
GCGCCAAATCAACAAAGAGCGCTCAAGCAGTATTCGTTTAAAGAGGAGCATGTAGACACCTTGTTCCAATTGCTTCGGAAGAACAAC
AAGTTGCAGCTGTCCGAAATTAGGAAGCCGGATGAAGCAGGGAAGGTGGATGACCCTAATTATTACCGTTATCATAGGTTCCTAGGG
CATCCTACCAGAAAATGCTATGTCTTCAAAGACATCCTGCAAAATTTGGTGAATGCTAATGTGCTCACTTTAAAACCCGAGCAGAAG
ACCGTATCCACCAACATGATAGCGGTCCAATTCGGTGGCTTCTCTCCGATAGCGACTACAGATAGCGTTGTCCCCATTCGTAAAGGA
GAAATGCACCTGAAGAATGCTGACTTGCACAAGCAGAAAGATAGGGGTTGGTACCCCTCACTACCCCAAAAGGGGAAATCATGTGG
GTCCACCCTGATCTGCTAGGAGACCAACAGTGGACAAACACCTCGTCCAAAAAGAAGGGAGGCAAGGCTAAGTCTTCCAACATGATA
AGCCCCTCCGTTACTGAGAATGATGATCACCTCAAACCTCTTACCGATTCAGAAGAAGAGAGGATTGTCCTGACAGCATACCCGGGA
GACAATCCTAGCACTCGGTCAGGAAAGGCTTACTTGAGAGACTACAACCAGAACGCTCAAGAAGCTGAAGAACAGCCCTAAGACGCT
GGGGTTCTGTACCAAAGAAGCCGGTCGATAAAGGGAAACAAAAAGAGCTTCGGTTCAACAAAAACCTCCACCAGGAATTTGGGGAA
TCGAGCTCTCCTTTCCAATTCAATGTCATGGCGCAGCTGGCCAATATACCGGCCAGGATTACTCTATATAAGCTCCTAAGATTGTCG
AAAACCACTAAGGAAGCTCTAATCGAAGCCTTAAAGAACACGGAGAGCTTTATCACTCAAGTTACTCCGATTTCTGAAGCTTCTGAA
GACCAAACCTGCCTGTAATGTCTACAAGCGGCAAGGAGTTTACCTTGCATATCATTTACTCAGGAAGATATGCAGGTTACATACAAA
CATGACAGACCTCTATACTACACAGGGTATATTGGGTCGTCAGAAATCAGTCGTGTCCAAGTTGACCCGGGATCAGCGCTCAGTATC
ATGCCCTACAGGGTCATGCAGGTCTTAGGGATTCCCATGCATCGACTAAACACTACTCAGACTACCATCTTTGGGTTCAATGTAAAC
AACACTCGGCCCCTGGGGAAGATCAAACTCATGTGTCAAATCAGAGATATTAACTCCGAAGTGACTTGTTACATCATAGATGCGGAC
ACGTCCTACAATCTTTTGCTAGGACGACCATGGATACATGCAAACCGCATTGTCCCATCTACCCTACATCAGGTCATGAACTATGCC
AATGATGAGGCAGAAGTTCAAACCCTAATTGCGGAAAAATACCCTTTCCGAGGAGTGAAAAACTTTCACACCGACTCCGTCTTCTAT
CTGGAATCCCAGGAGAAAGAAGATGTGGATAGCGGCAACGAAGCCGACATTGAACCGGATCCTGAAGAAGATTGACCATGGGAATTG
AATCTAAATGTAATGGGTCAGGACGAGAGTAATAATAATGTACCGAGTGAGGGCGAGTGGTGCATTAATGAAGATTTTATTTTGGCG
TACTTGTCTGATGTGTCCTCTAAAAATAAACAAATAGAGAATGATCCTAATACAGGTACCAACCCATGGCACGCACTGTGCACAGAG
GCATCACTCACATTGCCAATCGAGTCATCCTTCGCTTCAGATGAAGGAGTAGAAGATGCACAGAAGGCTTTATTCAAAGTCCCATCC
AAAAGGAAAGGCCAGAAGCCGATCTGTTTTGGTAAAGTCAAACACGAACAATTCAAACGAGGAAGTTCAGAGGAAGATGACGAAGTT
CCCCAATTCCATTACCACGAACCTAATTCTATACACTTAATGAAACGAATAGGGTATAAGTTTAATGAAAAATAGGGTTTAAACTCC
GGGAAAGGAAGGCGAACACCAATTCGAATGTCTCTAACCCTCCAAAGGAAAACCTCCGGACTACTATCAAAAAACCGGAAGAGCGTGT
AGGCTACGTCACAACCCCCTCTGTCTTAGAAAATAAAATCAGTAATTATCTGCGTCAGGACCATTCATCCGGGACATCTTCTTGAGA
ACCCAATGTCAGTGTCGGACCTTTCTTTAAAAATCTGACTGTGAATATGCTTTCAACTAGTCATCCAGATAAAGACGCAGGGGTGA
TGAAGAGTTAATCAAATCAACCAATGATCATTGGATCAAATGCCTCAACATTTTGTGGATATGTGCTTCGAACAACGTGAACCTCC
CACTGAAGATAGAGTGATTCAAGTCAACATAGGAGATGAACATGACCCTAAGCCCATTTTCATAGCTAAAAATTTATCATCATCCGA
GAAAGAAGACCTTATATCGCTTATTTGAGAGTATATAGATGTCTTCGCTTGGAACTATGAAGACATGCCTGGCCTTAACCCAAAAGT
TACCATGCATCGGCTTAACATTGATCCGGATGCAAAACCCGTTAAACAACAACAACGCCGGTTTCGTCTAGAGATCATGGAAGCAAT
TGAGTCTGAAGTTAAAAAGCTTATAGACTCGGGTTTTGTCAGAGAGGAACAACACCCAGATTAGGTATCCAATATTGTTCCAGTTCC
CAAAAAGAACGGTAAGGTCAGAATATGCATCGACTTTCGTGACCTCAACGCAGCTTGTCCAAAAGATGAGTTTCCTCTTCCTATCAC
TGATGTCATGATCGACAATACCTGTGGATATGAAAGGATGTCTTTCATGGACGGATTCTCTGGGTACAATTAAATTAAGATGCATCC
TGAAGACGAAAAGCATACTACGTTCAGAACTCCACTGGGGGCGTATTGCTACACAGTGATGCCCTTCGGCCTGAAAAACGCAGGTGC
AACTTATCAACGCGCAATGAACGCCATCTTTCACGAACACCTACGTAAGAAGATCGAGTGCTACGTTGACGATATAGCAGTAAAGAG
CCAACATAAAGGCGATCATCTTACAGACTTGAAAACAATGTTCGATATCATGCGAGCACATCAACTGAAGATGAACCCAACAAAATC
GTTCCTTGGGGCTATCAAGCGGAAAATTCCTAGGATTTATCGTCACATCCAAGGGAATCTCTCTTGATCCAGAGAAAGTGCATGCTA
TCCAAGATATGCCACCTCCGAAGAATCTCAAAGAACTCAGGGGATTGCAAGGGAGGCTGGCCTACATTCGGAGATTCATATCAAATC
TTTAGGGCGCTGTCAACCTTTCTCTAAGCTCATAAAGAAAGGAGTATCCTTTGTCTGGGATGGGGATTGCCAAAGAGTATTCGAGG
AGATTAAGAAATATCTTAACCAACCGCCGGTTCTTGTAGCCCTAATATCGGGAAAACCATTCCTGTTATACGTGAGAGCTATGGACC
ATTCTCTGGGAGCTTTATTAGCTCAGAACAACGATCAAGGTCAAGAGCAAGCCATCTATTACCTAAGCAGGACTATGATGAGAGCCG
AGCACCGGTATAATCCGGTCGAAAAACGAATGTCTCGCTTTGGTATTTGCAGTTCAAAAGATGCGACATTACCTAGTTGACAAATAA
TTCAAGTCATCTCTAAGGTGAATCCCTTGAGAGTTCTGATGATGAAGCCATCATCTCTAAATTGTCGGCTCGTAAAATAGGCCATTC
TCTTGTCACAATATGACATACAATTCATGCCCCAAAAGGCGGTCAAGGTCAAGCACTGGCAGACTTCTTAGCCGATTATCCGGTGC
CAGGGACATCTAAATTGTACGAAGAACTACCCGATGAAGTCGCTGAGGCTTGCGTTACTCAAGAAGCTACGCAAGTGTGGAAATTAT
TCTTCGACGGTGCATCTAGAGCAAATCCTCATGGAGCAATTACCACAGGAGTGGGGGTCGTACTCGTTTCCCCAAACGGTCATGTGA
TCCCAAGAGGGTTTTCACTGATCGAACCTTGTACCAACAATGTAGCCGAGTATAATGCGCTGCTATTAGGAATGCAATTTGCTGAAG
AACTCAATATTCGACATCTCGAGGCTTACGATGACTCTCAGCTCATCGTAAATCAAGTCCGAGGGGAATACGAGGTGCGTCATGAGG

Fig. 13AT

ATCTAATCCCGTACTACTTCGCAGTGCTAAAGCAAGCTAAAAGGTTTGAAGGTTTCTTTATTGAATACATTTCGCGGGCTCAGAACG
CTTATGCAGACGCTTTAGCCTCTTTGGCAACTTCACTAGCATTGCCACCAGGGGCTGAAACAATGATTCTAGTCACGGGACGCGAGC
TATACTATTACAAGATTCCTATAGAGGAAAGCTCGGACAAGACAATGACAGGAGAAGTCTGTACAACCTCTATGGAGTTCAAATCTA
GGGATTGGAGATTCCCATATATCGACTACGTCCTGTACGGAATCCTGACCGATAACCCTAAGGAAGCGGCCTCTATCAAACGAAAGG
CCCTCCGATTCTATTACGATGCAGTTTCTCAAATCCTGTATCGTAAATCACATGATGGAGTTTTGCTTCGATGCCTCTCTCAAAAGG
AAGCAAAAGAACCCCTCAAGGAGGCCCATGACGGAATGTGCGGAGCTCATCAACCCGGAGATAAATTAGGGAATCGCCTCCGACGAA
TTGGCTATTACTGGCCAAAAATGTTCTTAGACGCAGTCGACTATGCTAAACACTATCACACATGTCAGATTCATGGAGACTTTATCC
ATCAAGCGCCAGGTAACTTACATCCCACATCTGCGTCTTGGTCATTTGAAATGTGGGTATGGATGTCGTGGGACCAATCTCACCTC
CGACTTCCAAAGGACACCGGTTCATTTTGGCTATAACCGATTACTTCTCCAAATGGGCAGAGGCAGTCCCTCTAAAAGAAGTCAAGA
CAAAGAATGTGATTAAGTTCATCAAACATCACGTCATCTACCGCTTTGGAGTCCCGAGACGAATAATTCACGATAACGGGACACAAT
TTGTCAGCTTTGGATTTCAGAGATTTTGTGATAAGTTTAGAATCCAAAGTGTCGCATCCACGGTGTATTATCCGCCCGCGAATGGTC
TTGCGGAAGCTTTTAACAAGACCATCGTGAAGCTTCTCAAAAAGTTTATTTCCAAGAGCTGACGCGATTGGGACGAAAGACTTGGAG
AATGCCTATGGCCTACCGCACAACGGTGAGGACCCCTACGAGAGCAATGCCATTCTCTTTAGTATACGGCTGTGAAGCTGTACTGC
CACTTGAGATTCAAATCCCTTCCTTGAGAGTCGCGATTACAGCTGGACTAACAGAAGAAGAGAAACATCAACGACGTCTACAAGAAC
TTGAAGCCTTAGACGACAAATGACTTCAAGCTCAGCAACAGATCGAATTCTATCAAGCCTGTATTTCTAAAGCCTACAACAAAAAGG
TTAAAGAACGGATTTTCAAGAAAGGCGATTTAGTTTTGGCCAACAGACGACCCATGGTGATGACGCATAAAACCAAAGGGAAGTTCA
ATCCCAAATGGGAAGGCCCCTTCGTGATAGAATCAGTCTATTCGAATGGAGCTTATCGCCTCATCGATCAAAAAGGAGACAGGCTCA
TGATGCCAATTAATGGGAAATTCCTTAAGAGATACTTCCCGTAAATCGTGTAGCCCCCTTCCTTCTCTGTTAAAGGCTAGTCAAATT
AGACTGGGGGTTGCCAATTCAGAGTGTATTTCAGGAATAAATACTTTAATTTTCCTGTTTTGTATGTCATCATGTTAACACTACACCT
CTGACGATTGAAATTTTCTGGAATTATTCTAAGTGGTAATAAAGAGAATTTCAATTTTATGCTAAGTTAACACTACACTTATAACAT
TTGCATTACTTTTCATTGTCCTGAATTAGAATCCAACAAAAGAGACGATGAAAGCCAAAATGATATCATTTTCATTCAATATTGTTA
ATCTAAATACAAAGTGATGGCAATCGAAATGAAAACGATAAAAAATTATTCCTCAGCCAAAAACAGTGCAAAACCTAAGCATCAGGC
TTCATCAACTTAAGAGATTTCAGCCTGGACTTGAAGGCAGAAAGTTTCTCTTGGTGGGCTGCTCGGACCTGTCCTTCAATCTCCTTT
CTAAGTTCTGTTTCAATAGGAGCAGCAGCAACAATATCTCTGCCGAATCCTCTCGGCCGCGTGAAGCGTACGGCAAAAATCTGTATAA
ATCTGGCTGCTTTGAAGCTCAAGCCTTTTTCTGACATCTTCGTATTGGGCCAATTGTGCTTTCTTCCGGTCCTACTCATCCTCTAAT
CGAGTAATAGCTTCTTCAGTGGCACGAATGTCAGAAGCAACACCTTTGATATTAGTATATGCTTGAGAGTGCTGCTTCCGTAAGAAG
GATATGCGAGCCTTTTTATCAGACAAGTCCTTGCGAAGCATCTCTCGATGATGCAGCTTTGAGATTGTGCCTAAGGACAGAGCCGGC
TCCACTTCAGACTTCAGATTGCTATGCTGCAGCTCTTTGAAAGCTGTCAACTCTGCCTTTAGCAAGATCATGCTCCCTTTACAATGC
TCAGTCCATGATACATCACCCTTATCCCTGACTTTATCCAAGCACTTGTTCAGGATAGGCTCACAATCCTCAAAGGAAGCTCCCTCA
ACACTGACGATATTAACAGTCGTCTGTATCCAATGTTCCAATTCCTCAATTAATTTCTTCAAAGCTCTCGAGCGTGGAGGAGGAATG
GTTGGATAGATCAGACCTGTATGTTCATCCCGGACCGGTAAGGGAATGACTTCGGAAGGAGAGCCTTCATACATACTTTCATCCCGG
GTAAGAGAAGGAGAAGTGGATTCAGAACCTTCAATGGGCGATACCTCTTCGGCTCCAGCATCCTCAGGAATAGAAGGGATCGATTGG
GGCATTTCGTCCTCTCTATCAGTTAAACGCGCAACAGGCGTAGACTTCATCGCGTCCCCCAGTAATTTGGCCCTATTGGAATTCTTA
GCAACGATAGGTATTCTCTTACGAATTCTTCTGTTGTATTCTTCTTCCTCGGCAGCGGAAAGAACCTTTTCCCCCGACGATCTTAAG
GCACGAGGTTCAGGATTCGACACTTCTGCAGGAATCTCCTCAGCTGTCTTTTCTTCGGGAGAATCAGCAATTGGTGTTCCCTCTTCG
GTCCCCATAGGAACCTCTTCCTCAGAAGGTTCTGTGGTGGGCAAATCCCTAAGGGCTTCAACGGCTCCGGCAGCTTCCCATTCATAG
GATAGATATTCTTCTATCCCCGGTAGACGAGTCTTCGTAGAACCGCTCCTAAAACGATATAATTCCCGAATCTCATTTATACAGGAA
GTATAAAATATCATATGCTGGTATTTGAGAAGCCTCATCAAACCAGTTGCGAAAAATCTGCAATGGTAGAATAGCCGGCCGGTGAATTA
GGTAAAGTGAAGTGCGCGTGGGTCCCTCCGGCGGAGAAGAAGTACCATGCGCGAGCTCCTTCATACAAATTCCCAATTTGAGCCAAC
GCCGGGTTAGCATTGCCAACGTAAAGTTGGTCATATTTGAACTGTCTAGCAAATTGAGAAGCCATGTAAGGCTCAATGATGCACTTC
TCCCGTAAGCGATAGACCAGATAGCCCAACCTGATCATGAGAAGCCATCTGAAGGTGCCTTCTTCTAAAGAGAATGAACCCTCAAAA
AGCACGTCCATCAAGCGGGTGTTCTCCTCATCAGCCCCATCAAAATTAGGAGCGTAATAGAAAATCGGGTAATTGTCTTCCCGGGAC
AAAAGCTGTCGAGCCCTGACTATATAAGAATTAGTCCACGTGGCTGACTCCAATCTCTGTACAAAGGGAACATAAGCGTCGTCGCCC
TCAGATACTCCCGTCATCAATGAAGGGCAATGCAACACGAACCAGGCCACCAAATATGTATATGGTACTGGTACACCGTGGTGAGAA
GCCTTCCTAGCTTTCTTCCTAGCAACCTTAATTCCCGGGGCGCCGAGAAGTTCGGAGGTCAACATCCGTAAGCCGCTCTGTATGCAG
CTTACCATAGCAGTGAGGAGACTCACATGTCTCCCATGCGCTAGTAAAACAACTGGGTACACAACCTCAGCTAATATTGCCTCTACT
GGTTTTGACGGTACTACACACCGCTTCAACCAAATCATGAAGAAGCCCGCAAGAAGAGCCGTGTCAGAAATAGGAACTGTGGCTTGG
TGGTGAAAACTTTCAAATTCAACATCAGCCTCAAAATCATCCTCTGCATACTCTGTCTTGTAAGTAGCACTGGAAGCCTTAATTCGG
GTTTTAGCGTCCTTAAGAGAAATGGCTGCAACACGAGATACAACTACGTCTTTCCGGTTTAAGTTCTGAAAGAGGTATTCCGCCCAC
ACGGTATGCATAATGCCCCCTCCACGCATCCCAAAGAATTGAGCACATATATGGAACTGTCACATCAACTCCCAGAAAGTAGCAGGC
AAAGCTCCTCGGTGGTAGGGATGAATTCCTCGTAGGGCATTCTACCAAACGACAACCCCGATACTGCTTGCATCTCATGGAGAGCAA
AGCCTAACTCCCCTATAGGTGTGAAGAATGTGCAGCTGTTCGGGTTATATTTCTCCAACATAGCGAAGAAATTGTGATAGCTTTGCA
CAACCCCCCGTCGAGTAGCTAACATGGGAATGGTGAGACCCGATTGAGCGAGTGGTTCCTTAAGCTCCTCAAGAACAAAGTCAACCA
TACGAGTCCACCAACCTCCTTCTCCAGAACAAACCCACCCTGGGGATCTGAACATCTGGGTAGAGAATTCACCCCGAGCTGTAATGA
ATTGGCGAATGAAGATATTCGCTGGACCTGGCACCTCTGGAATGAGATCCTTCTTCTCAAATAAGCCGGGTCTCAACCCCTTGAGTT
GTCCCCTGATTTGTGTACGAGCTGCCGACCAAATCCAAGCAACACATTCTCTTTCTCTTTGACTATGTCAAAAGTCAAACCCCCGC
GACAGCTCACGTTCAAGAAGTAGGAAAGCGGATACATCCTCTTCATACTTGGGAGGAAGAGGAAAAGGTTACCGACTCTCCGCAGTA
GTTTTGACTCCCCCGCATGTATGAGATGATCATCAATTGCTATACGATCTCCGAATATAAATGCTGGTTTGGAAACTGAGCACGAC
CGATAGGGGTCTCCATGTCCAAGTCAGTGATTAAAATTCTGAGAGTAGAGCATCAGGGGAATTTAATCATGTTCGCTCTCTCCGAGT
CAGGGAAAGTACACAGTGGAATTCTGCTCTAAAGACTGAAGACTTCATTCGCGTCAGGACCGCCAATATATCCAAAATGATGCTCTT

Fig. 13AU

GTGAAAGCGGCACGTTTGGGAGAAGCACTGCACAATCAAAAGCACAGATTAGCAGCTAAAAGCAAGCTGTTAACATAAATACAGAAT
CTGAAACACAAAAGGCCAGCCTCATGTCAGAAATCTCAAACGTGAGAGTCGAGCCTCGTGTTAGAAATCTCAAACGCGAGAGTCGAG
CCTCGTGTCAGAAATCTCAAACGCGAGAGTCGAACCTCGTGTTGAAAAACTTAAACGCGAGAGTCGAGACCCACATGGAGTCCCAAC
TCCGCGTTTTCATTAAACAGAAACCAGTCATCTTCCTCGTTATCAAGAACCCATATAGGGTTTTCAAAGAACTTGCCAAGCCAAGTT
GTTTTGGTCATCACTTACCATGACAGGGAGACCCCCGCGACGGCGACGATGACGTTCCCGCAGGAACAAGAACACCGCCGACGTCCT
CAGCCCACGGCGTTTTGGAAGTCGCTCCACCGACTTTCTTGGATCTAGGGCTCATTCTTCGTGATGCCATCGATATAATCGGTCGGA
GAAGGCGTCGTCGGTCGAAGAAGATGAAGTTCGTCGGAGATCTTGTCGAAATCAAATGAGAGTTCTCGTTCTTGGAAATAGCCAAAA
ATGGAAAGAGTCGAATGACTCTTGACATGACCACTCAGGTCTATTTATAACAGCCGTCAAGCTGTTAAGATGGCACAGGATTCTAGG
AGAATCCCAACCATTTTATCTTTTAAAACGCAATCTTTCGTGTTTTTAGATAAAGTCAGTTAAGACTTTAATCTCAACGTGAAGTTC
ACACCCACGTTCAAACGCTAGGCTCAGACCAGCGTTATGAAGGTTCTTAACCTCGCATTTCGTACCTCAAATGCAAGAGTCACCTTA
GCGTTGTAATTTTTCCAAATGAAGAATCTACCCTTGATACTTATCCTCTAAGTTCATGGATTCTTTCAACAGAGTGCTTTTAAAACT
CTATATTTCTTTAACATAATCTAAATACTCATCAGGTTAATATTACACCTCAGATGATCATCACCCCAATAGAGATTGAATTTAGTT
GTCATCACTACCAATATGACTACAATTCCTCTGCTAAGGTCCATTTATCGATTCTCATTAATAGAACGATAAATCTCCAAAATCATC
CAAATCCTGGTTAATTGGTCAACTCTCTTCAGCAGAATATCAAATAACCAATTGACCTAATTCTTTTCGATGGGATGATAAAAATTC
CCCGAATCTTGTTCAAATCACAAGTGATACAATTCATCGCCCTGATAATAAAACACTTAGCAGTGCTCCCCAATGAGATGCTATAAT
ATTTTTTCCTCACAGATGTCACCTTAAAATTACACCTCTGACAAAATCAACTTATTGATTCTCATCAATAGAGCGATAAGTCCTCAA
AATTGCCCTGATTGTAATATTTCCCATGCCACGTTAAAATTACACCTCTGACAAAATTAACTTATCGATTCTCGTCAATAGAGCGAT
AACTCCTCAAAATTGCCTTGATCGTAATATTTCCCATGTCACGTTAAAATTACACCTCTGACAAAATTAACTTATCGAGTCTCGTCA
ATAGAGCGATAAGTCCTCAAAATTACCCTGATCGTAATATTTCTCATGTCACGTTAAAATCACACCTCTGACAAAATCAACTTATCG
ATTCTCGTCAATAGAGCGATAAGTCCTCAAAATTGCCCCGATCGTAATATTTCTCCTGTCATGTTAAAAATCACACCTCTGACAAAT
TTAACTTATCGATTCTCGTCAATAGAGCGATAAGTCCGCAAAATTGCCCCGATCGTAACATGCCAACAGTCCAACCCTCATACTTGA
ACCTTTTTCCTCAGTGGATTAAACTATTTCCTAAATTATCCCTAGGAAAATTTGTGAGTTTCACTCTATGAGGAAATTCACGCCAAA
TTAAAATTACACTTCTGGCATTTATAGTCTTCATTTAGTGTTTAAAGCGAAAGCGTAACACAGGAAGAATCCTATTAGTTAGCCCTA
TTTTGGGAGAATAATAAAGTGTTTATTCTCAGCAGTTAGAAATTTTCTAGAGTTATCTTAAAGGATAATAAAGAGAATTTTCTAAAT
CAGATCTATCACGGAATTTTGTAATTTTGTTGCTTCGAGATTAAAACATCACACATGCAAGAAATAATGAGAAACTAATATCACTTT
TTTTTATTTCAGAAACCAAAAGGAAGTGATACAGAGCCATTCTTAAGAAAAAGAATAATACAAGGTCAAGTCAAAAGAAGCAAGTTG
AGCTTTGGCATCAGAAAGCTTTTCCTCATGATTAGCCCGTACAACGGCTTCAGCCTTCCTCCGCAGCTCATCCTCAGTGGGTGCTAC
TTCAGTGGCTGCCTCCTTCTTCGCTCTTTCAACAGCCTGAGCTTCTTATGGTAACTCAAAAGAGTGTCCGGGTTTTTGGCACCAAGT
ATATTAACAACGGCTTCTTCGCGAGAAAGTTGGGCCTTCAATCTCAGTACCTCCGCCTCAGCTTCGACAAGTTTTGTATGAATGAGG
TCCAGAGAAGCAGTAGAGAGCTCCAGTTCTTTTTGTCTTAGATCGCTCTGCTCTCGCAAGTGCGTAACTTGAAGCTCTTTTTCAGCC
AGACCCCGTTCAATTGCCTCACGGTGAGTCACTTCCTCAACTTGGAGGTCAACAAAAGTAGACACGATCTGTGTCTGAATGTCTGCA
TGGCTGAGGACTTCTAAGTGTTTGAGCTGGGCTTCTAAGTGAGAAATGGCTTCCGAACAACGTTCAAAGCATTGTGCATTGCCCACA
CTTTTGACTCCATTTAAGCCTGCTTCTAAGAGAGACTTAAAAGAATCAAAGCGGCCTCGACCAACCGTGACAACTTCAATCACCTTC
CTCACGAGACTGTTCAAATAACTCAGGGAAATATGGAGGAAGTCAGGAGCGTCCGTTGGACTAGAAAAAGCAATGGAAGATGACTCG
ACGACCCTAGAAGTGGACTTATCAAAGTACGGACTAACAAGTGATCTGGGTGTAGAAGTCGTGGAAGCAACTGAAACATTTAATTAC
GAAGGACTTGAAGTCAAAGCCATCATTGTCCTTGCCTAAGACGTGCTTGGTCCGGCTTCTGTTGGTGCAAGTAAAATCCTCATCAAT
GCTGCCGGTGAAGCAATTGCCGTGGATGAACTGGGCAAAGGTTGCTCTTGCATAGGAGCTGATACTTGCACAAGCTGTTGTTCTAGA
GAAGGAGTCACAGTAATAGCTCCGGGCAATGTTGCCGGTGAAACAGGCACCATGGATGAGCCAGGCAAATGCTGCTCTTGGTAAAGGA
GCTGACACCTACATGAGCTGTTGCTCCGTAGGAGGAGTAGTAATGATAGTCCCGGGAGGAGGTGAACCTGCACGAAAAAAGGGTCGG
AACGCGGAAAGAACATGTGGAAGAATTCGAAGAAAACTAGGCTTACCGGAGATGTGAAAAGGAGTATAACCAGACGCTTTATCGGAT
GGGACCTTGGGAGCATCATCAAAAATGGTTATGTCATCCATAGAATTATGCTCTTCGTCCTCCACGTCATCACCTGGCATGTTGCCA
ACGCCAGCATCCTCATCACCTCTATCTTCATCAGCTGCATCACCAATCGAGGAGCCTTCATAATCTACTTGCTCCTCATCATCCTGT
ATAGCTGAAGATTCAGGAAGACTTGTGCCAGTAGCTAGTTTAGTCATAAGTCCCGTTATCGGACTAGGACATAAACCACCAGCCTGT
AACATTAGTGCTGAAGGAGGAGGGATAGATTCTCTTCATGGCCCTGGGATTCTAACACAGGAGCCCTAGGAGGGTCTGCTACTGGA
GCAGATTCTGCATCTGTGGCCATTAATTCATTCTCTTTATCCTCGGAGGGATGGTGAGAAGAAGCTTCACTCGATAAAGCCGGGCCT
TACGAAGGAGCCCAGTTCTATGGGGAAGGCCTGCAACTAAAGATTCATGTTGTTTTTCATCTTCAACAGCTCTGATAGCATTAGCCA
TCAACTTTGGTTTCTGCTGGCCTTTAGGAGGAGGAGACCCAACCATCAGATTCCGACGGGTCTGCTTATCGTATTGGCCAGTTTCAT
CCACCGAAAGTTTTCTCTTCCCAGCTGCCCCTGCTGTGGAAGAATCTACCAACCGGGGTTCCTCCACTGGAGCAGGTTCAGTTGCTT
TCTCCTCTCCCTGTCCAGCAGAAGGGTCCTCAATGGATAAAAATTCGTCAATTCCTCTTAGGCGGGACGTCTTTGATCCCCTCCTTG
AAGCATACATACGTCGGATATCTTTCAGACAAGACGTATTTAAGTTGTAATTGGGAGTCTAAAAAGCGGCAAAGTACCAGTTGCAGA
AGCTTATGGAAGTATAAGAATTGGGTGTTTTGTGGGGAAGCCTGAAGATGGCTTTGGTACAACCTGCCACAGAATAGTACCAAGCCC
TAGCCCCCTTATATAAGTTGCTCACAACTGAGAGCTGAGGTCAAGGGTTCCCAACATACAGCTGATTATACCCAAATTGGCGAGCCA
ACCTATAAGGCTGGTAGGGCTCGAGGAAACATTTGTCGTCTTGCCGGAAGACCAGGTAGCCTGGCCTGATAGAAAGGAGCCAATGGA
AGACGCCCCCGCTCAACTGGGTGAATCCGTTAGGCCCCGTCACGTCCTGATACTCTGCTCCATAGACCCCGCCTTCAAAATTGGGAA
AACAACGGAAGATGTGGTAGTTGGTGTCTCGCGACAAAATCTGGCAAATCCTAACCATATAACCCCCCCTCCCATTTTGCAGATTCT
AGTCGTTGTACAAACGGGATGAATGAGTCACCTGGAGGAGAGGGTGCACTCATTATGGAAGGATAGTGAAGCACATACCAAGCCATC
AGATAAGTGTAAGGCAGTGGTATCCGAGGATTGGGAGTTTTGAAAGCCTTGTTACCACCAGACTCCACCTCTGTAACATCAATAAAA
TCCAAAGCCAACTCACGCAGCCCACTCTGCAAGCAACCCACCATGGCGTAAAGTAGATTCAATGGCCTCCCGTGTGCCAAAAGAACA
GCCGGGTAAATCACCTCAACAGCGAGAGCATCAATTGGCCTGGTAGGAACGACGCACCGCTTGAGCCACAACATCAAGAATCCAGCC
AACAGCGCTGTGTCGAAAATTGGGATCAGAGCTTTATAGTGGAAACTTTCAAACTCCGTATGAGTCGAGAAAATATCTTCCTTGGCC

Fig. 13AV

TCATTGGTATAATGGGAGGTAGCAGCATCGATTCGGGCTTAAACCTCCTCCAAAGTGCTGGCAGACAATCTGGTCACCGAAGCTCCT
TTATTGGTCAGGTTCTGGAATAAATACTTCGCCCAAGACACTTGTTTGATGCCACCTCCTCGAGCCCCTATCTGCTGCATACAAATG
TGGAAGTGACACATCACTTTCCAAGGAGTAGAATAAATTTCGGGACTCGCTTTTCTCAAATTTTTAAATTTCGTCGATCCTGGAACA
AATTCTTCATATGGCAGATCCCTGAAAAGAAGACCCGAGACGTGGTGCATCTCGTGAAGAGCAAAGCCTAACTCTCCCACCGGGGTG
AAGAAAGTACAGGTCTCGGGATTATACCTCTCTAATATAGAGAAGAAAAGGAAATAACTCTGGACGATCCCAAACTTGGTAGCTCGT
ACTGGAATCTCCAGGCTAGCTTGAGTAAGAGATGCCTCCAACTCCTTCAGAACAAAGTTGGTCATCCGAGTCCACCATCCTGTCACT
GGAGAATGAACCCAACCAGGAGTTCTAAATCCTTGCGCAGCTCAAATTTTTAAATTTCGTCGATCCTGGAACAAATTCTTCATATGG
CAGATCCCTGAAAAGAAGACCCGAGACGTGGTGCATCTCGTGAAGAGCAAAGCCTAACTCTCCCACCGGGGTGAAGAAAGTACAGGT
CTCGGGATTATACCTCTCTAATATAGAGAAGAAAAGGAAATAACTCTGGACGATCCCAAACTTGGTAGCTCGTACTGGAATCTCCAG
GCTAGCTTGAGTAAGAGATGCCTCCAACTCCTTCAGAACAAAGTTGGTCATCCGAGTCCACCATCCTGTCATTGGAGAATGAATCTA
GCCAGGGGTTCTGAATCCTTGCGCAGGAAATTCCCCCTTCCTAGTCATAAATTTCTTAATAAAGGTATTCGCCGGACTGGCCACTTC
ACCAATTGGATATTCTTTGGCAAACAAGCCCGGTCTTAAAGCTGTCACCTGTCTGTTATAACCCATAGTGCGAACCCCCTGGAAAGT
TAAAGTGCCAAGAACAACCCCATCTTGATCCTTGACAAGGTTCCAATCCATACGCCTTGGGATAGAGGCACATTGGAAGTATGATAT
AGGGAACATCCTCTCCATATTGGGCAAGAAAAGGTTGCGGTCTCCAACTTTCCACAGCCACTTGTAGTCCCCATCATAAGCAATGCC
TGCCTCAAAGTCAACAAAATCCCCGAAGAGGAATCCATGTTTGACTATCGGTTTACGGCTCAGGTTCTCAAGTCTAGCGTCCGTAAC
CAATATCCTAAGAGTTTCAGGAGAAGCTTGGGTAATTAGTTCCACACGGCTCTTCTCCGTAATTCGGAAAACCAGGAGTTCTCGGCG
CAGGTTGAATGTCATGTTCAGATCCACACCACCTTCATGCCCAAAATGATGGCGAAAAGGGAGAGGCTCGCTGGTATGACGCACTAC
AAAATAAAGAAAGAAGTTAGACAATGAAAAGGTAATCAGACGCGGAGATCGAGTCTCGCGTCGAAAATCTTAGATGCGGAGATCAAG
CCTGGCGTCAAAAATCTTAGACGCGGAGATCGAGTCTCGTGTCGAAAATCTTAGATGTGGAGATCGAGCCTCGCGTCGAAAATCTTA
GACGCGGAGATCGAATTCCGTGTCAAAAATACTAAACGACAGAGTCCAGCTTCGCGTTATCGAAACGAGTCCCCTCGTTGATTCAAA
AATAGGAACTCATCGCGGCGAGTTTAACGACCACAAAGGTCATGCTCACCACCGATTAGAGGATATATATATATCCAATAAAGTTCG
GGATGACCAACTTCAGAACCCCTGGTCACACCAGGAGTTCTATAGAATAAAATCCCTACCTTTAGAGGAACCAACTTCAGTTGAATC
AACTCCAACGGTTGGTCCTGTAGTCGCACCAGGAGTTTTCCCCGATAATAAATCAGAGATATACTGATGGTCATCTTCTGATAGATT
AAGATCAAGGTTGTGTTCATTAAGATCCTCAACCTCAACAGCGTGAACGGTCTCTCCTTCGGCCGGTTCATTCATTGTGCATCTAT
AGGATATAATGAGTCATAAACAACATATATACTTATATGAGTCCACACAAATGGAAATCAGCTTTACCTTCAGTGACCCCGGGGGAC
TCGACAACTCCACTACTTGCACCCACTTCCTTTAGTTTCACTAAAAGGAGATAAAGTGTATAGATCATTAGAAGAGGTACGCATTCT
GACACACTCATCTCTCGAAATTTCCCTCCGAATAGAGAAATACCCGTACCTACGCTTAGACCTGATAGATTAATGTCAAAAGTTGTT
TGAACCCCAGCGGGGTTGTCATCCATCGCGTCGTGCATTTGTTGAACGAAACTGGGTTCCTTAGTTTCCATAATACCAGGAGAAGCA
ATGTCAGCCTGAATCTCTCCTTCTTCTTGACTCCCTGCGGAAATCGAGTATGGGATGAGTTCAAGTATTAAGAAATACGAGAACAGT
AAAATGAAAAGAAGGATGAATCGTTACCTTGTTCATCTAAAGGAACGTTGTGGGCAGATGTCTCCTCTAAGGTAGGACGAGGAATAC
GTGGTCGAGATGCAACCTTCTTTCTTCTTTTTAATGGGTGCGCTTCCCCTTGAAACTAAGATCTCTCATGACGATACTTGGTGCGCA
AACTCGGCTGTCGGAGGATCTTGAGCCTGAGTTAAAGGTCGAGATCTATGTCTCTGAGCGAGGGCATCATATCTTTTCCTCTTCA
TCTCCACTAAGGACCTCCACCGTCATTCGATTGGAGATGTCATAACAACCCTCTCCCTTCTCCTTTTTGGAGCATTTGGTGATTGA
GATGGGTCAGCATAATGCGTCCTGTGAGCAACGAAAGGGTTTACATATCCTCTTTCGAAGAAAGAGGAACGGAGACCAACCTCTCTC
TCTTCATCACCAGTGTTAAGCTCGGCATCCCAAGTCTCATCTTCAGACCTGATGTTAGCTTTTCTTTCTTCCTCAGAGGCTTCTGCT
TCGTCACTTTGAAATTCTTCTTCGCTGTCATCCGAATGAATTGGTTTCTTGCCTTTTCTTGAAGATTCAGCAGGCTCTTTTGCTTTT
TGCAAAAGCATAGTTTCACGAACAACCTCTGTAGCATGTTGAGATGCAGCCTCCGCTTCTAATTCGGATATCTTCCTTTTCTTAGTA
GGAGCGCTAGCAGCTATTAGCCATCTACAATATAGGAAGGTCATCAGTAGGGAGGCTGTTGCCGTCAAAAAATGCTAATAGATATC
CCAGACATAGAGAAAATCACTCAAAGGCAAGAATGAACTGTCTCGCCAGCGAGACAGGCTTTGCTGTCTCGCCAGCGGCACAGGCTT
TGCTGTCTCGCCAGCGGGACAGGCTTTGCTGTCTCGCCAGCGGGACAGGCTTTGCTGTCTCGCCAGCGGGACAGGCTTTGCTGTCTC
GCCAGCGGGACAGGCTTTGCTGTCTCGCCAGCGGGACAGGCTTTGCTGTCTCGCCAGCGAGACAGTATTGAAATGGTCAAAACTGCC
TTTGTAACTGCCCGACACGTGGCCACTAACTGTTCAAGAACGTGCAGAACGTCGTGGGCGAGAATCACGTGGATAACTGCCAAAATA
ACGGAGTTTGAAACGTGGAAAGGCANNNNNNNNNNNNNNNNNNNNNNNNNNNNNNNNNNNNNNNNNNNNNNNNNNNNNNNNNNNNNN
NNNNNNNNNNNNNNNTCCCGGCACAGGCAAAGAACCCACGAAAGCAGTGATCCAAACAACGATCCTACGTTTGTTTCCCAAGAGTTGT
AATTTTCATTTTGTTGTGTAAAAGAAGTCTTATAAAAAGACTATTTCTTTTGAATTTATTGTAATCGACCGAAGATATAATGAATTC
CATGACAAAACAAACTTTTGGCGAAAACAAACTGGCGACCACAGTGGGAGCCAACGGTCTCGTTGCCGAGACCGTCGTGTCGCAGCC
AATCATCAAGATCCCGATTGAATCCATAGTCGAATACGAATTCGACCAAACCAAGTTTGAGGAATATCTCTCATCGTCCTCTTCAAG
ATCTTCATTGTCTCGCAAGTACAAGAAGATCTCATCATTGAAGAAGACGTCTATGCCAAAGAAGGCACAGAATGAAGACTCTCGCTT
GATTGTCGCTGAGGATTCCACTCGCAACCTCTCTGCTCATAATGGCTCTTCGCCAAGTAAAGAGTCATTAAATCAAAGCCCACCGGC
ATTGACGAAAAGAGCTCGTCAAAGACAACGCCAACGCCCGGCTCGCCAAATGGCTAAGGCGTTAGAACAAACCGACGGGGTTCGTTA
TCTTGCGGACCTAAAGTTAAGGAGGCATCGAGTGGTTCAGTTGTCTCAACGACCAATCACTCATGTCTCTGCTAAACTCACGACGAA
GGAATGGACTATTGTCAAAAGGACTCGTTCGACCCTCAAAGAACGTATACAAAAACGTCGTGCAAACGCTGCTCATGCCCGTGCTCT
CTTACAACAAAGACGAGAAGAGAAGAAGGAAATGGTGGTCAAAGAAACACCGAAACTCCGCCAAATTTGGATTCCAAAGTCTGAAGT
TGTAAAAAATCAGCATTCGGAGCCCGTTAAGACTCCATACCCACAAGGGGGTGGTGTTAAGCGTGCGACTCCCGACATAACCTTGGA
TCGCTCAAAGACAAAAATAAATTGTCCTGAGAATGCCAACAAGGTTTTACACCCCCAGAAGAAGACGCATTCATCAAATGATATCGT
CATACCTGGGAGGTCATGCCAACAGACGATACGATTTTTTGGCAATCATACCGATGAATCGTATTATCAAGTTGGGGTTGTGAATAA
CTTTCGAAAGAGAGTTATTCGGGAAATAAACTCTTGTTGTTCCTGTGCCCGACTCGTTAAAACAGCATTATCAGAATGTGACTGTTT
TAAACGAGAAGCTATCTCACGAAGAGTCTTTGTATTGTCGAAGCCTAAGCCGAGACATTTCCACAAGAGAAAATCAACTGCCCAAGA
TGATGAATTCCCTGAAGTCACCATCAACGTGGCTGATAAAAGAAAGTCTAAGCGGCATTCAAATGACTCAAATCCTGACTTTTCTCC
CAGAGGAAAAGTCAATCCAAGAATTGCTCAAAGGATGTCTCGACTCCAATTAGGAGCCATCAGACGCAGAGATTACAAAAGAATGCA

Fig. 13AW

AGAAGGAATGTCCTCGGAGGATGAATTCTCGGACACTTATTCTGCAATCGCTTCTGATGATACAATGTCTAGCACGGACAGACCAG
AGAAGTACTTACAATCACCTCTGATCAGTTCGCTCAAATACTTCAAGAAGCTCTAGCCAAACAACGTGAAGAAATTAGAGCTGAAGT
GAAGACAGAAATGGAGTTAGCCATCCAACAAATGAGAGAATTGCTAGCTCAACGGCTTCAACCCCCTGCGTCCAGTCAAAGAACTGA
ATCCATCCGCCACACTCAGAAAGTTGTGGATGACAGTGATCCAGAAGTGGATGAAGTCATTATGGCTGATACACCTCCCAATAGCAA
TAACGCTGGGGGTGGTTTAACACATTCTCCCAATAACGATATTGGGAGTGGTTCAATGGCACCTCTTACAGGGGGTGGTCTAACTCA
TTCTCCTCAACCTCATTCGAATAAAGACATAGACGATGACGGGAAAATGAAAGAGCTTGAAAACAAAGTCAACGCTTTGATGACGGC
TCAAGAAGTGAAGAGGACGGGTATTCCATGTCCCTATCCAAGAGAATGGAATTCAATACCGTACCCGGCAAAATTCAACATGATTAA
CTTCACACCGTTTGACGGGAAGAGTTCGCCGATTCAGCACTTGATTTATTTCAAGTCTCATTTGGGCATGATCTCTGGAAACGAGGC
TTTAATGGTCCGGTCATTCGTTGGCACCCTTCGCGGGTCGGCCTTCGATTGGTACCGACGGCTCAAGCCAGGGAGCATCAATTGCTG
GGATGACATGGAAAGTTTATTCCTCAGCAATTTCTTTGATGATGACACCGAAGTGTCAATCGGAACCCTTTTGGATGAGAAGCAAAA
AGACGGAGAGTCAGTTGACAATTTTGTCAAACGTTTCCGTAACAACGACGACATCCACAATTCCTGTGAACGCGACTCTCAATCCGG
GATTCCAAAAGGAGTATTCTTTCGAAGATGACGAAGCTCCAGCCATATTGGAATACCTTCTCGCCAATGACAAAATCGAGCTACCGC
CTATTAAAGATCAGGAGGGTTCTAAGATGATTACAGATCCAAACTACTTGCATATCACAGAAGGGTTCTTCATCCCACCAATATTT
GCTTTGGACTCAAAAATAAGATCCAAGCATTAATTGACTCCGGCGTCATAACGGCGAAAGAAGTCGAGTAAAGACGACCATAATACT
CCATTGGATACACGAGTATAAACTGTTTTCCCTGACTCCGATAAGTATACAAGTATAAACTGCTTCTCCACCTCACTCCAAAGAGTA
TATGAGTATAAACTGCTTCTCGGTCATCCAACTAAGTACAATGCTAAACCCAGTTTTGTAAAGAAAGCTGGGGGTGGATGATTTATG
TAACGGGAAGTTCCTGGAGAATCGTATATTCTTAAGGATAACCCGAACATACAACTGATGATAACATATTCTTTGTTATACCCAGTT
TTGCAAAGAAAGCTGGGGGTGGATAATTCATGTAACGGGAAATTCCCGAAAGAATACTATATGTAATTTTCTTAGGGATAACCCGAT
CATTACATAACAAAGTGATAAACACTATATCCCCACGATGATTTTTGAATACTCTTTTGTTAAGGTGAGATTCGATCACTTCGTTGG
ATCAATCTTCCCTCACAAAATTCTCTCATGGTCAAACTTTTAAACGGTTAGGTCCAAAGCCAAAATCTCCTCTCGATTCCTTCAATG
AACGAGAGGCCCACAAATTGAACGATTAAACCTTTAAACAGTTAGGATCGTTTCAAAACTCCCACTTGGTCAAAACCTTACTACAGT
TAGGACCACAACCAAAATCCCCTTTCGATTCCTTCCAGGAACGAGAGGTCCACTTTTAGTTGAATAATCAAACCTTGTGACAGTTAA
GATTATTACAGTTAGGATTATTCAAACCAGTCTAAACTCTCTAAGTGGAGATCCCACTTTGAGTTTCTTTTGCATCAGGAGATAGAA
TATAAAATTCTTCCTCTCCAATTCTGGGTTTATCTCTACCAACAAACAAGAGATCAGGAGATAGAATATAAAATTCTTCCTCTCCAT
CATCGGGTTTATCTCTACCAACAAACAAGAGATCAGAATACTCCAATAGGTATACGAGTCTAAACTATTTCCCTAATCTCAACAGGA
AGTTTCTGGAGAATATCACTTTTAAATTTCCTTTGTACCAGGAGATAGAATATAAAATTCTTCCTCTCCATCATTGGGTTCATCTCT
ACCAACAAACAAGAGACTAGGAGATAGAATATAAAATTCTTCCTCTCCAGGAGTGGGTTTATCTCTACCAACAAAAAAGAGACCATA
TTACTCCAATAGGTATACGAGTCTAAACTGTTTCCCTACCTTCAACAGGAAGTTTCTAGAGAATATCAATCAAAATATTCTTAAGAA
TAACCTGAATACTCCAATAGGTATACGAGTCTAAACTGTTTCCCTACCTTCAACAGGAAGTTTCTAGAGAATATCAATCAAAATATT
CTTAAGAATAACCTGAATACTCCAAATAGGTATAAGAGTCTAAACTGTTTCCCTATCCTCAACAGGAAGTTTCTGGAGAATATCAGT
TAAAATATTCTTGAGAATAACCTGACTACCCCTAAACGGGTATATGCAGTGTCAACTTGACGACAAGAGCTGATTTCACAAGTACAA
GTTCCAGCTTTAATTCAAGATCTCTACAATGGACAAGCGATAAACGCGATGCCGGGAAGAATCTTAACTATTCTACAAAGCACTGAA
TAGATTGAGAGACAAAGAGATCAAAAGTTGAAGCCACCTACGGGTTCCTCTACACGATCTACTCAACCAAGCATTGAAAGGATCGTA
AGTAAGATCTATCTTATCCAAAGCATCCCAGAACTCCTCTATAAAAGATTGAGTCTGGAATACTTTGGAGGGGGTATCTGTAGGCGT
CAAAAAATGCTGAAAGATATCCAAATACAGCTCAAGAGGAAATCATCCAAAAAGGCAGAAAAAACACAAGTCTTGACTGTCTCGCCG
TGCGAGACAGACTTGACTGTCTCGCCGCGCGAGACAGTCTTTACTGTCTCGCCGTGCGAGACAGTCTTTACTGTCTCGCTCTCGCCA
GCGGGACAGGCTTTGCTGTCTCGCCAGCGGGACAGGCTTTGCTGTCTCGCCAGCGGGACAGGCTTTGCTGTCTCGCCAGCGAGACAG
TATTGAAATGGTCAAAACTGCCTTTGTAACTGCCCGACACGTGGCCACTAACTGTTCAAGAACGTGGAGAACGTCGTGGCGAGAAT
CACGTGGATAACTGCCAAAATAACGAAGTTTGAAACGTGGAAAGGCAGTTAAAATGAGAAACTGCATTTTCCGAGACAGTATTTACT
GTCTCGCTGGCGAGACAGCAAATTTACTGTCTCGCTGGCGAGACAGCAAACACTGTCTCGCCCAGCGAGACAGCAAACACTGTCT
CGAGCCTGTTTTCCACCAACTGTTCATGGAGGTTATAAATACCCCCCGAAGGCCATTTTTGAGAGGGCTGATCATTTGAGCACTTC
AGAGCAGAGAGAGCAGAGAGCGAGCAGAGTTCCTGAGCTTCCGGCCACTCCTTGATATTCAGGCTTTGACTTGATTTCAAGAAGAAC
GACTATCTTACTTCGATAAGATATCGTTTCAATTTCTAACTTCGATAACGAAGGAAGAATCAGTAAACCCCTCTTCACGATCTGTGA
TTCGGTGGTCCACGAGCTAACGCGCTCCCGGCACAGGCAAAGAACCCACGAAAGCAGTGATCCAAACAACGATCCTGCGTTTGTTTC
CCAAGAGTTGTAATTTTCATTTTGTTGTGTAAAAGAAGTCTTATAAAAAGACTATTTCTTTTGAATTTATTATAATCGACCGAAGAT
ATAATGAATTCCATGACAAAACCAACTTTTGGCGAAAACAGAGGCATTGACAATGGCAGGTCAAACTGAGCATTTGTACATCCAATT
ATGCTCCAGAATTAAGCTCTTGCCCCGTCGATCAAACCCCCACAAACTCTGAGGTACTTGTTCGGATTTCCAACATAGAGCTAATCG
TACCCAAACTGGCGAGCGAATCTCCAAGGCAAATATGGCTCGATACTGCAGATATCCTTCACTCTGAAAACCAGGTAACCAGGACCA
ATATTCATTAGCCACCTGAAACATGATACTGCAGATATCCTTCACTCTGAAAACCAGGTAACCAGGACGAATATTCATTAGCCACCT
GAAACATCCGACATCCAATACAGACCTGTCCTGCCTTGGCTTTTCTATATCCAATAAAGTGTCATTGTAGGTACCGAAAAATTAGGG
AAAACACAAACAGAACTCCCAACAATTATGAATTCTAAATTGCCGGGACACGTCATGCCATTGTTTCACTACCCACTTGGACTCCTC
CAAAATTTGTAGTAAGGGGAGATCTGGATTAGCATTTTCTGGAGATGACATTAGATCCAGTTGGTGAAGAACTAACCAAGTCATTAA
ATAAGTATACGACAATTCCATTTTGGGAATTGGAATCTCTGTAGAAGGCTGCCTTCCCTCTTGTGTAAATGTAGTAGCTAGGTGACG
AAGCCCACTGTGAATGTCGGCTACCATAGCTGGGAGAAGAGACAGCTTACGACCTGTTGCTAGCTGAATTGCTGAATATAAAACCTT
GATAGGCATTGCATCAGAAGGTTGGTGAGGTACTACACACTTCTTTAACCAAATAGCTAAATACCCGACTAAAAGAGTTGTTGGTTC
AATCTGTGTGCCGGCTTGCCATAAAAATGATCTAAATCTGGTGCCATGAGGAAATCCATCTTCTGAATAGGAAGTATACATTTGAGC
ATTCGTTCTCTCCAATAATCCATTAATCTCCGATGGGGATAAAGGAGGAAACTCATACACTACTCTGTCGGAATGATTCTCAAGATT
CTTGAACATGTAGTCAGCAAACTGTTTTAAACTAAGCTGTGCAGACTTCTTCTTGGCCTTACCTTCCATTGTTGCCATCACAGTATA
ATAGTGACATGTTAATTCCCATAAGGTGTCATAAGCTATTCTAGCCCGCTCCTTCATCCTATTCAGTTGACCAACCGTCGAAAAGAA
TTCCTGATAGGGCACGTCAACCATGGGTAATCCAGAAGCTTTCATCATCTCATAGAGAGGGAGTCCCAATTCTCCATTATTGGTAAG

Fig. 13AX

AATATGTTGGTGTCGGGGTTATAAATTTCAAATAGAGCAAAGAAACGATCAACATTAATTTGTAGACCATACATATTAGCTCGAATG
TGGACGTATAATCCACTTTCATTCAACTCGTGCTCCCAACGTGTTAATACGTAGTTGGTCATTCTCGTCCACCACTTATCTCCAGAA
TAATGGACCCAGCAATAACACCTAAACTTATTAATAGGGAGCTCTCTTCCTAATCTTGCTAGGCGACCCTTCACAGTGTTAGCCTTA
GCTAATATTTCATTTTGAGAGACATTGTCTTAGCCTGGAATACCCGGGTGAAGCCCTCGTACGGAGTTCTTATCACTCGACCATGGA
GTCTTAGCATCCTTCCCAAGAAAACCGCAATGGACAGCTCGTGGTCCTCGGTCAACCTCAAAGACATCTCACGACCTACGACTAAAT
TCCTAAACCGTAAAAGAGAATGGTGACGGGGAATTGATGGAAAATACCGGAAGTCTGAACCATACTCGTTCAGCTATTGTGTAGGGC
GACAAGAAAGGGCCTTAGGATCCTTCACCGAATCTCCAAAGAGGTACTGTGGCTTCCTCAACGATTATGTCGAATCCGGGTCCCATG
TCAAAGGAGTGTCTGTAATCAATCGGCGTAAAGTACGGAGGTCTCCGACGTCCTTCGGACAATCCGTAGAAAATTGAGGTGCCTCTT
CAATTAGAGGAATTCCCTCATAACGAGAGTGCGTGACACTACTCTGACCAGTAACTTCTCCATCCGGGAAGGTTTAAGAAGGAAAAT
AGATTGAAAATAATAATTATACACACACACACACACACACACACATATATATATATATATGTATATATATACATATGTATATATATA
TATACATACATATCTATATATATACGTACATACATATGTATGTATGTATGTAACATACATATATACTTACATGCATATGTATATACA
TACATATATACATATATACATGCATGCATATATATACATACATACATACATACATACATACATATATGTGTACATATGTATATNNNN
NNNNNNNNNNNNNNNNNNACGCCGACGCCGACGCCTCCCCTGCAGCGCTCCCTCGACGCCGACGTCGACGCCTCCTCTCGAAGACCC
TCCTCCTCCCTCTCTCGACGCCGACGCCGACGCCCCGTCGAAGCCGCTTCATCCTCTCTCTCTCGACGCCGACGCTGGTAAAAACCC
TAACAATCTCTCTCGATCTCTCCCTCGATCCCTATGTTTGGATTGTGCTAAAATTAGAGATGGATGAATTTTTTTGGTGATGATTTT
TTGGAGATGGATATATATGTTTTGAACTGAGTTATGATTTAGTTTGCATCATGCAGCTCTGCAGTGATTTCGTTTGTTTTTAAATTN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNGTGGTTATTGTCGTATGATCCGTGTTTTATTTTTTCTGCTGTTCCATTA
TTGTCGTATGCTTCCTTTTTCAGCTTGTGGTTATTGTCGTTTTATTTTCTGTTTACTTACAAACAAGAAAATGTATCAAATTTGTGA
GAGTTTATTTGAAATTTGGAAGCGCTTGTTTGTGGCTGTTGTTTATTTGAGTTTATTTGAGAATAATCAAATGCTGGCCATGTCTAA
CGAGTTTGCCTGCTGTTGTTGCTGCTTGTAATTTGTGATATTCATTGTTCTTATAATGTTGTTGCTGCTGGACATGTACTTGAGAAG
TCAACGAAGCTCATTTGTAATGTTGTGTATGGTTCTTTCATTGTTCTTGTAATGTTTTTGCTGTTGGACATGTACTTGAGTTTATTT
GGAAGGGCTTGTAATGTTGTTGCTGCTGGACATGTACTTGAGAAGTCAACGAAGCTCATTTGTGATATTCATTGTTCTTGTACTTGA
GAAGAAAATACAGGATAACATGTACATCTATAGAATTTGTGTTGAAATGAAAATTCACTGCCAGCTCTGACTCTGATGCTTCCAGTT
TCCACCCCCTGATACTCTAGAACTTAGTACAGCACTGCGCCAATGCAGCTTAATAGCTTCAACTTATAATAAGCACAAATCCAATAA
CATCAAACTGATAACAAAGAGATATTATAGACAAAGAGCTCATGGTGCGATCTTTTGAGCTGTTGATATCATAAGCCTTTGCCCAAG
CTTTCATCTGCAGAAAATGCATGAAACGAAATCAAATGGCCAAAATATATGACAGCTGACTTATAAACCAGTTCTTTGATCAAATGC
AGGCACAGTTCAAGAACTTATCAGCTCATAAGCCTTTGCCCAAGCTTTCATCAGCAGAAAATGCATGAAACAAAATCAAATGGCCAA
AATATATGACAGCTGACTTATAAACCAGTTCTTTGATCAAATGCAGGCACAGTTCAAATGTAGCTAAGATTGCCTGAATACATCAGC
ACAAATGTAGCAAATGATAAACACATATGCAGCACAAATGTATCGACCATAATATAATACATCCAATAACTCTCACAAATTAGAGAC
ATTTTCTTGTTTCAAAATAGAAATAGTTACAACAAAACTCATTGTTGATACATTCAGACTTCATGCTTGGATTTTTTCAAATTGCCA
CAATTGCTCGAACCACCCACGTGCATGTGAAAGCTAAACTGCCACCTGAAATGATTCATAAAGTCTGGTTACACAGGAGTAGAAAAT
AAATAAAAGATAATTAGATTGTTCTATGTTATATGTTGACTCATGCATGGAACCAATTATTATATGCTTGAAAGCGAAACAGAAAAT
GGAAGCAATTTAGGAAATTTAACAAAGCTAAATTGCTACAATATGCCCCTCTTAATAAGTTGTGATATCTAAGCGGAGGGTAATCCT
ATATATTATCTCGGAAAACTAAATTGAACATTAATGCGGCTACCATATGACCGTCGCAAAAGGGGAACAAATTCCGACATACTTACA
TGAACAAATCCATGCATGTGGAGCTCAAGAATCCAGACATATTTTCGTTTAGCTGCAAATCACATGACAAATTAATCATATAATTGT
ACCAAGGAAAAATTATGTATTATGAACTTTCATGAAAAAAATATAAACTTCATGGTTCTCAAGTTGGTGCATTCCAATTGCATCTAT
AGATTTAGTTGCAAGTACAAAACAGGCCTGGACTCTATAACATGTAGGTTTCAGAAATCAAACACTCCAGAGGTTGCATTTATCATT
TTGGAGGTAAAAAAATTAGTGCATCACCAAAAATTATTACATCACCAAAAATCACTTTAAATCCCTACAAACAGATCTTACACAGTG
TAAGAAATAGATGTAAACAAGCAGGCTACACCCTTTATCGGTTGCATTTATCAACTAGATAGCATAATTAGGATACTCAACTAGATA
GCATAAGAAATAGATCATGAACTGGCTGTCACTAATAATTCCCCAAAGTAGGATTAATATAATCAAACCCGTTCAAATCCACAATCA
TCACTTGCTAGACCATCTCAAATAGAATTTCAACACAATTAATTCAACAACAAATTCACAGCAAAGACTCAATTCTCAAAAACAAAG
TCGACCTCAAATGAAATTTTAAACCCCTGCAAGCACACAGATAAACCCAAAAGAAACTCCTAACCTCAAATGAAATTTTAAAAATAG
TAAACAAAGTCTATAAGCAAGCAGAAACCAGTTTTATCACCGTCCTCGTCTATGTTTGTTGATTTTTTTCTTAATTAACTAGGTCAA
TCTAGAGAGGGATTAAGAGGGATAAGCTAAAATTTTTCCTGACAGGGATATCGGGGCTGGGGTTGGCGGCTCGATCTCACGGTTGTT
GATTTGGGAGGAGGACAGGGGGAGGGGAGATCTCGCGGCGGCTTGGTCGGCTCGAGAGAGGGATCAAGATGGAACTCACGGCGGCTT
GGTCGGCTCGATCTCGCGGAAGAGATGAGAAGGAGGGAAGGGGGGCTGGTGGTGGCGCACACAGAACGGGGGGCTGGAGGCTCTCAA
AAGGCGGCGGCTCAGAGGGGACTCGCGGCGGAGAACTCGCTGCAGATTTGAGAGCGGCTCAGAGGGGAATCAAAGAGGGCTTGGAGC
GGAGATCCCTCGCGGCGGCTTCGATTTGGGGCGAGGACGGGGGGAGCGGATCTTCGGTTTTTTCGTGCTCAGATTTGAGAGAGATTT
GGGGAGAAGATAGAGATTTGATGAGAGAGAGAGAGAGAAGGTCACGGAGGACACACACACACACACACACACACACACACACACACACA
TATATATATATATGGTTGGAATCTATTTAAAAGGGATGTCCAAAAGCTAAATAAAGGGTTGAACTCATCTTGTGAGTCCACGATATA
GAGTCACCATCTTACAATAGACGAAACGACTTCAATTGGTACAACATGAAAGGCAACATACATCGCCGAGTATGAACACTATGGCAA
TATACATGACCTTTAATGTGGAACAATATAAAATCATCCCTACTGCTTTTAGATGCGTTCTGTCCAAGCAAAACAACATCTTTTAGT
GTCGATCCTCTCAAATGAGAATACCGGCTCTTCCCGACTACCTCTCGAAGGATAGCAAACGAGGATTTACACACATGATTCATAAAA
TATTGGATTTAAATCAACAAAAGTGGAGAAAATGTAACTCTATGTGAAGCGACAATGGGCTCCACCCTATCGACGGCATGAGAGACG
GATCTACCCCTCGGGATACGAGATCTCTTCGGTGACATGATCAAAGTCAGATTTTTATCAAAAAATCCTACAAAAAAGGTTAGAATT
TTGGGGTTAAAGCCTGTCAAATCACAGATAATACCCAAAATGCAACTATTGGGTTCGAATTTTACCTAAAATCAAAGGAAGAGAAGA
ACCCCGAGAGAAGAAGGCTCAGATCTGAGAAAGAGAGGCAAAACCCTAGAATCCCACGAATGAAATCCACCCAAATTCGAGCAAAAG

Fig. 13AY

GGAATGAGAATGGGTTGAAGAACACTTGGACTAGGATTTAAAGAGGTTTTGAACTTAGAAGGGGCGGAACAATGAGGTTGAAAAGCC
CCGAGGGTCGTGTTTTATAACCCACTAGAAGCTCCTCGACTGCCCGCTTCCGAGACAGTCGTGACTGTCTCACATTTCCGAGACATT
CACAACTGTCTCAAAAGAAGAAGTAATCCCTACCCTTCCAAGACAGTTACGACTGTCTCGGAAGAAGAAGTAATCCCCACATTTCCG
AGACAGTTATAACTGTCTCGGAAGAAGGATCAACACCAAACATTTCCGAGACACTTACAACTATCTTGGAACAAGGATGACCCAAC
ACGTCGTCAATGGCATTTGTGAAGCATTCTCGACCCATTTTTGGCATATTTGAACACTCTGATGAGTATATGAGTATAAAATTCATC
TCCTTGAATCTCCTAATGGGTACATGGGGTTAAACTGGTTCCCGAAAACTCCAAGGAGTACACGAGTATAAACTCATTCTCCACACT
CCAACGCCTTAAGAGCCTAAACTGTATAGATTCCAGTTAACATATGGGTATAAACTGTGTTTCTATCGCAATGAAGGTTGACACCAG
TAAAAGCATCGATAACTATGCCAAGTCGAAGGATAATTCATGGGAATTCATACATAATTTAGATATTAATTTTTGAACAAGATGAGT
AGTTCATGGTTGATTCAATGGCACAAGCTAAATTCAACAATCAACACAAGAACTTCAGTTCAAGATTTCGACAACGGTTAAGCGATA
AACGCAACACCGGGAAAATTTTAGCTATCCGACAAAAACTAAATAGACTAAAATATGGAGAAGTTGACGAATCAAAGTAGGAGTGTA
TCATATCCAAAGTATTCCAGACTCCTCTATAAAAAATTAAGGCTGAAACACTTTGGAGGGGGTGTCTGTAGGCGTCAAAAAATTACCT
ATAGATCATCGTATGTAGCTCAAGACAGAGAGAAGGCGATAAACTACATCATCTAAGTTGCAACTATCTCAAAAAATAGGAAGCTGAC
CACGTTTCCGAGACAGTTGTAACTGTCTCGGAATTGGGAAGCTCATCATGCTTCCGAGACAATTACAACTGTCTCGGAAATAGAAGT
TCCCCGGTGTGACTTATTTTCAACTTTCATCTTCAGTTACAGTTCCTAAAGACTATAAATACCCCCTAAGACCATTACTGACGAGGA
GCCAAGCAGAGAGAGCAAATTGAACAAAGAACATGAGCATTTTGGAGCGTTCTTAACAAGAGAGAGAGAGTCTTCATAAAATTCGAG
TGCAAACAGTAACTTTGAGATTCCTTAAGATCTAAGTTTCGACTTGATCTTGAGAAGAGTGTTCATCTTACATCGATAAGATATTCA
CTTAACTTTTTCTTACTTTTAAACGAAGCAAGAATCCAAATTATCTTCACGATTCAATCAGAATCTGTGAATCGGTGGTCCACGGGC
TAACGCACCCCTGGCACAGGCAAAGATCCCGCGCAAGCAGTGATCCAAACAATAATCTTGCGTGTGTTTTTAAGGAGTTTGTAATTT
AATTTTTGTTGTAAAGAGTAGTTTTACAAAGCATGAAGCTTACTCTTCTGTATTCATTATAATCGATAAATAGTTATAATGAATTCT
ACAACAGAACTTGTTCCTGACGCAAACATGGAGCTGCATCGATCTCCACCACCTGCGATATTTCCTCCGTCAGGACGTTCTCCACCT
GATGAGAGCTAGGAAGTTTCAAGATAGAAGCCTCATTATAGACATTAAAAAATGCCAAAATTCAAAAGGTGAAAAGAGAGGTCAGGG
AAACGAACCCCTTTTCAATCAGAAACTAGGTTCATTGTTTAGAAAAGATCAACCTCGAGAACGAGAGTCGCCATGCAGCAGAACTCA
ACATCGAAAGATAAAGTTCATTATTGAATGAAACGGATCTACGAGACTCGGAGCTCGTCATTGGATACGAGGTTCGAGGTTCGCTAG
TGAATACGAGACTTGAAGCTCATCATTGGATACAAGGTTCGAAGTTCACTAGTGGATACGGGGTTCGAAGCTCGTCATTGGATACGA
GTTAGACTCTAGCTGTCAGCGATGAATCTCGTCATTGGATTCGAGGTTTGGAGTTCATTATTAAAGATGAAGTTCGTCAGTGAAGAC
AAAGCTCACGAGGCTCGCCAAGCAGCGAGGCTCGACATCAAAGACGAGGTTTGCTAACGCAGTGAAGTTCGTCACCCGCATTAAATC
AGGCTGTAACGGTCATAAAGACCCAGTCAGCCACGTGGACTAAATTCAAGGAGTCAGTTACGCCACGACTTCACAATTTTAGCGCAT
CAGTTATGCCCACGACTCTACTATTGTAGCACGTCGGTTACGTGCTCAAACTCCTATAAATAGCCATCGATGGCTACAGACAAAGGG
GTTGGTTGATTACTCTGAATTGGATAATTTCAAGTTTAGACTTAGAGAAGCATCAGAGTTTAAAGTTTCTACACGTCAATCCGTAGT
TCGAACCTCGATTCCAGCCGGTTAACCTACGTCAGAAGCTCTTACGATCTTGGTCTGATCGTCAACGGAAGGTAAGCTCGACTCAAG
CATCGGGGAAGCATCCTTTCGCCACCTAGAACCTACGTTAAACAAAAGAAAAGTTGAATTAATCTTCTCTTCATCTGTAATCGAGA
GAGAGCCTGAGTGATTGTAAGGGTTTCGTACCAAGTGATCGAACCCATTTCTTAAAACAAGAAAATCAATCCCAACATCAATTTTTT
AACCCTATAGACAATGCAGACCACAGTAGGAGCAGCTATTCTCTCCGACGAGATGGTGGTGGCACAATCAGATAAGATTGTACTGAG
AACAAACGTTAAAACTCTGGTCATCGAATTTGACCAGTCCAAATACGAGGAGTACCTCTCCTCTGGTAAGTCTAGTCCCACGAAGGC
ACGAAAGTGTCCGTCGAGTCTCGTATGAGACTTCAGCCCAAGTGGCTTCTGATGATTCAACTCGAGTTATCTCGAGGAAAAGTCCAAG
CCCCTCAAAGAGGAGGCTCTAGTAATTAGCCGTCAGTCTAAGAAATGGGTTGTCAAGCAACCTAGCCGAACTTCGGCTTCTACCAGC
CAAATTACGGCTCTTGATAACGAACCACGCCCAGCTTCGGCTGAGGCAAAAGTTTCTGTTATTCCATTGTCGAGACGTGCTCGACAG
CGTCAGCGTCAGAACCAAGCTCGCTGTAGGTCTCAAGCTTTGGTCTCGCTAGATGATTTTCATTATAGACCAAAGGTTAATCAACCT
AAGGTTAACAAGTCTGACGAGGGTCAGGTGAATGAGGAACGTCCAAAAGACGGACCTCATCCTCATACCCTAGTAGACTCAGAACAC
GAACCTCATCCTCAAAAAGAGGTTCAACATAATCAACAAGCGGTTCATACCGAGGTTCATCAAGAAAATCAACCTTAAATTAAGAAC
CGACTGAGAAGACGAACTCACCAAACTCGTTCTAATAATGAACCTCGTCATGCAAATGATGGAGTTTGTCAACTTACCCAAGACTGT
CAACCTCTATCATTTAGAGGGTCTCGCTCGGGTAAAACCAAGATGATGGAGTCGACTGAGGGTTGCCCAGCTGGCGACCTTTGGGAT
TATCTCACGCGTAAGCGCAGCATGAGCCAAATGCAATCACATTGCTATTGTGAGAAGCTCATATCTGTAGTGCTTTCCCAATGTCCA
TGTGGGAGTTGACACATAAATCTTCAGTCTTCGAATGATTGACTGAATTTCCAATGGTCTCATCATCAAGAAGAAGACGCATTCGT
CCAAAGAAATAAGCATCCAAGGATCGCCACATTGAAGTGACGATCAACATGGCCAGCAAGGGTAAAAGCAAAATCTCAGCTGATGAT
TCAGAGTCTTCTAATTTTGAAAGATCTCTCGGATTACGAGAGGCACTTAGTGAAAGCCAGAGTGTTTATCAACATACTCGTTCTTGT
ACTGGGGCAATGATCCCATTAGACTACCGCAAACTAGCGGGTTTATCCAGCGGTGTTGGTGAAGAACTTGAAAATTCAGCCATTGTT
ACTTCCCAGCCCTCCAACACTGACCAAAGTGAGCAAGCAAGTGCTCACATGACAGGAAGAGAGGAAGAACTTTCATGGTAGCTGGAA
GATCAATAATCTACCATCCTGAAGCAGCAGGAGTCCATCAGACGACTGGAAGCGATGGTGGAAAAACTCCATGAGGAAAAGAAGAAG
AAGAAGACTCATTCCCAGGCCTCGGGATCTAGGCGTAGAAGGCCTTCACCTGTTGATGAAGATCACTATGATGAAGACGATGAAGAA
AGAGTTGTGAAGATTCATTCTAAATCGTCCAAAGCTGAACCTAATCCTCGTACAAAAGAACGAGATCAGAAGTGGGAGGATTTTCAG
AAGCAGCTTAACGCACTGAAGCTTCAAGGAAACTTCAAAGAGTCGGGGGTGTCGAGACCCTATCCAAGTGAATGGGATGCGATCCCG
TATCCTCTGAAATTCAAACCACTCAACTTGGTGCAATTTGTTGGCAAGGGTTCTTCGACCCAACACATCTATTATTTCTAGGCACAG
ACTGGACACATAGTGGGAATGATCCCATTATGACTCGACTCTTCATTAGTACCCTTAAGGGGTGGCTTTCGAATGGTTTCGTAGG
CTCGAACCAGGGTCAATCCAGAGTTGGAGAGATTTAGAGAGGCTTTTCTTAGCCCGATTCTTTGACGATGACACTGAAGTGTCTATG
GCTACATTATTGTCTGAGAAGCAGAAGAAAACGGAGTCGGTCAGTGACTTCGTTAAGAGATTTAGAAATCGATCATTGTATTCACAT
GATCAAGTTTCCGAGGCTACTCTTGTGGAAATGTGCCGCAACAATCTTTCCATCAATATCTTATCTAAGATGGTGCTGTTGAAGCC
CGTTCATGGAACGATTTGGTTTGGTAGGCAGAGCAAGTGGAAAACATGCTCAAGAGGATAAATGTTGAAGAACCTCAAGAATCCCAG
CCTAAAAAGGGAGGTGGTAAAGGCAACTATAATTCCCAGAAACAATCGAAGGGGAAAGACACCTTAGCTATTGAGACAACTCCATCT
CCGAAATCCTTTACCAAGCAGAAAGGGAATTCATCCGATAATCGTTTTCAGAAGAAATACGATTTCAAAGATGAACATGTGGTCTCT

Fig. 13AZ

GTTCTTTCATCTTTAATCAAGATGAATAAGATCAAGCTGCCAGAAGTAAAGCGGAGCGCAGAAGTATTAAGGACTGATGATCCTAAC
TTTTGCATGTACCACAGGATGGTTGTCACGCCCCGCTTCCCAAAATACCAGGGAATCGGGACGTGAACAAGCCCCGACGTATTAGA
TTGAGAAGAAATATACACTATCTTTTTTTTCCTCTTTCTTTTCTTCTCAATCCAATACGCTAAGCGTCTAGAAACAAATACAATACG
AAGNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNGCGAAAAACGATACGATAATAGAAACAACAAAA
GAACGTACAACTGAAATCCACAAATCAACATGAAAATACTACTAAATCATGATAACATAAAGCATCCAAAATCGATCAGGTAACGAG
GTCATGCAGCTAGCGATTAGTCTAATCATCCAAGCAACAAGATCATACAATAGATGTAATTAATACTTAAAAATCTACAACTCGAGA
CGTAGTACGTCGAGCGAAATAATGCAAACAAGGAAACCCTCATGTATATACCATATGTCTCGAATTGTAAATAATTAAATATTAATC
CCGATCTATGTATAAAAAGAAACACAACTGGACTACCTCTCACAAGAATTCATACCTAGCCAAGAAACGAGGTCATGTAATTAGCCA
TCCTATAACAGGTCACTGGTTCACATCTCACATAGAGTCAAGGTTCACATTATCGGATATCTGGTTAACAACCACATCTCACTAGTA
CCTCAAAGCCGCCCCAGTGCGAAACAATTCACTGGTGCGTGCCTGAAAATAATCAATAATCACAATACCACTGCTCCTCAGACCCAC
CCCAGAGTGAAACGATCCACTGATGTGAGCCTGGAAAATACATAAACATCCACATATCACTACTCCTCAGACCCACCCCAGAGTGAA
ACGATCCACTGGTGCGAGCCTGGAAAATAACAACAACCACGATATCAATGTTCCTCAGACCCACCCCAGAGTGAAACGATCCACTGG
TGCGAGCCTGGAAAATAACCATCCACATCCGACCACATGAACCAAGAATTCCTCATCCCAACTCTTCTCGCTTTCCTAAGTCAACAA
TCATAATCCACACTATAACTCGGGTTCACCACCTAAACTCAGTCAACAACCCACACATGTCACTAAGTCTGTTCATGACGCATGAGG
CCCCTAAGTCATGAACTACTAATGGTTCTCAAACACAACAAGACCGATATTAATAACATTAATTTCACTCAACCACATCATGACATGT
CGAATACAGTAAAATATTCACAAAACATAAAATATAATCATGTACAGCAACTACGTAATTCAGAAATTAATTCCTTTCCCAAAATAA
TTTCTTTTAAAAATTAATTCTTATTATAATAATCCAAAATATTCTCTTCCCTAGAATAAATTCTTTAAAATTATTTCTCATCAATTA
TTATTCTAGAATAATTCTTTTTCTCAAAATAAATTCTTTTTAAATATTATAAATCCTATAAAATGATTTCGTCATCAAAATAAATTA
TTCCAAAAATACTATTTATTGCACGACTATGATTTAATCAATATTATTCAGCAACAACCCACGCAGATATATAGTCATAATATACTA
TGCAAATAATTCAGATCCGAGCAAGAGAGATCTTGCCTCGGGGTTTTCGTCGAATGAATCGATGTTGACACGTGAAGCTACGACCCA
CCGATGAGGTGACGGTGACAGATCTAAACGGCGATGAGGACAGCAGGCCTGACTGGTGGAAGTTCGACGATGCTATGCGGCTGGTCG
GGTCGGCGTCGCTGGGCTCGGAGTTGGCGTGGAGAAGAGGATCGCCGGCGTCACTGCAGGGGAGGGGAGGTCGGGGTTGGCGAGGAG
CTGCTGTCGGCGGCGANNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNAAGCTGAGGGATAGAGATGAGAGAGGAGGAGGAGAGAGGGTGTACGGGGGAGAGAAAAGAAAGATT
TCTTTTTTTTTATGGAAGGGGAGAGAAAAAGGAAGTATGAGAGAGAGAATTACGGAAGATTTTGGCGAGTATATGATATGTTTTTT
TTCAATTTTGAAATGAGACAAAAAATGCAACGATTTATTTTTGGCTCGACGAAAAACATGGCGACTGATTTAACGTTCATTGCAAAATT
GATTAGGGAGATTATGGTAGGAATTCAAATGACAGAAAATTAAGGGGAAAAAAGATTATGGCAAATATTTATTTATTCACTTATTCA
TAATATTTAAAAATAATCCTTATAATAACAATTAACCATATAATAACATTAATAAATAATTAACAGCTAAATATTTATATATTTACA
TATGTACTAATATACTAAGCTCAGGTTTACATTAATAATAACAAGGTCACTAATAATATTAGCTACCAAAAGATTATATATAAAATC
TCATTAAACCATAAATTAATATTTAGCAGAATTAAAAATACAAGACTATATATTTTATTATTTATTTATTTTAAAAACTCAGAAAAT
TCCAAAAATTAGGAAAAATATTAATAAAATATAATATAACATTTTAAATACTAGAAAAATTGTTTAAATACGTATCGAAAAAATTACG
GTTGTTACAATGGTGCATCATCCAACTAAAGCTTGCTACATCCTGAAAGACAAGATTCAAGCTTTATTAGACGCAGGAGTGATGACC
CTTCAAGCTGAGCAAAAGAAGGTGTCTGCAAATATGGTTTCACTTTAATTTGTAGATTTCACCGAAGTACAAATACAAGATGGTGTA
CAACCAATTCCTCAAGCCGAGGCGAGGGTGGTGAATTTCGACCCGCATCGGAAGAAAGAGAAGAGAAGAGTCCCTTACACTACCCTA
AAGGCGAACTGATGTGGGTTCATCCTGATTTGTTAATGGACAAGAAGTGGACATCGACAAATTCAAAGAAGCCTAGAGCCACACGAA
GATCTTGCAATGCTGTTTTAGCCCTTCCAGATGAGGGGGTTGAAACTACGTCACTTAGCAGTTCTGAAGATGAATAGCTAGCTTTCA
CTGCACAGCCTGCACAGGTATCAGGAACCCGCGAAGGAAAAGAGTATTTGAAGAAATATTCTGAAACGGCAGCTGCACCACCCAGAC
CAGGGAAAGAAGTAGCGGAGCAACCTCAACCTAAGGAACTTTGTTACAACAAAGCACTCAGAAAAGATGCACCGGAGAGTTCGAAAG
ATCCTTTTCGGTTTGATGTGCTGGCTCAGTTAGCCAACATCCCAGCAAGGATTACCTTGTTTGAGCTTTTACGTTTATCCCGATCAA
CGAGAGAAGCTCTCCGTGAAGCATTGGCGGATAACGAAGATTTCCTTACTCATTTTCCACCAAATCCAGCCGGAGCAACGCTGGAAG
AAGCTTGTCCTCAATGTTGTCACTCATTTCCACCAAATCCAGCGGGAGCAACGCTGGAAGAAGCTTGTCCTCAATGTTGTCAAGTT
TTTCGAAGAAGAATACCATGCATCACCTTTTCTCAAGAAGACATGCATGTAAGGAACCCAAAACATGATAGACTATTGTACTTCACA
GGGTACATCGGCTATATTCGGGTAGATAGAATTCAGGTTGATCCTGGTTCTGCTTTGAGCATCATCCCCTTGCGGTTCATTCATCAC
CTTAGAATTCCTCTGCATCGTTTATCAACGACGAGAACCACCATATATTACTTCAATGCCTCTAATACTCGTCCCCTTGGCAAAATC
AAACTTAAATGTCAGATGGGCGACTTGAGGATGGATGTTACCTGCTATGTCATCGATGCAGAGATATCTTACAACTTGTTACTGGGT
CGACCATGGATCCATAACAATTTGATTGTTCCATCCACTCTACACCAATGCATGAAATATGTAGGTGAGAGTGGTGAAGTAAAAATA
GTGGTCGCAGAGAAGCAACCTTTCAAGGGGGTAGAGAATTATTTTACTGATTCTATCCAATACCTTGATGGTGAGCCATTTGAGGTA
CCATTGATCGAAGAACCAAATAGTGGTAATGAAGCCGATATCGAGTCTGAACACGAACATGGTCTTGTTTTTAATGACACAGAACCC
GTTGTAATCGGTCTTGAAGATCTGAATGTAAATGATCCTGTCTATGAGGATAGTGGAATTATCTTTAATAATAATGATTTAGCTTAC
TTCTTGTGTGTGGAATTGAATACTAACATGCTAGGTACAAACACTGATGTGATAGCGGATCCGCTATCCAAGTTATATGCTGAATAA
AATTATACATACCGATTCAGTCGTCCTTTATGACAAATCGACGACAGACCGAATCTTCACAAGCAGTCTTCATAGTACCGGCTAAG
GCTAACGGTCAAAAAGACATCATCTTTGGAAAGAGTCCGGTGCAAACCATTTTGGAGGAATCCGAGAAAGAGGAAAGAGATCCACAA
TTCTCATACTTTACTCCAAGAACCCGAAGGCTCATGAAGAATATAGGTTATGATTTCATTCATAAACGGGGTTTAAATTTCGGCAGA
GGGATCCGAACACCAATACGATCTGCGCATGTCCCGAAAGGAAAGCCAGAAGACTATTATCACAAAACTCGTAGTGGATTGGGTTAC
GAATCTCCACCGTTTATGCTGTGTTTTGGGACTAAAGGAGAGTCAGATGATGATTCTTTCACCTCGTCTTCCAAATCCAATTACTTG
GAATCTGATACAAGTACATGAGCTATATTCAAAGTACTCATGGCTAACATGACCTCAGTATCTTTGATAGAGAATCAGGAAGATGAT
CAATTACTTTTGTTTGATGATCCATTAAGTCGACAGCTTGGTATATAGTGGGAACATCGTTTTGAACAACACGAACCCCCTACTGAT
GACAAGGTGATTCAGGTGAACATGGGAGATGAGGTTAATCCAAAACCCATATTCATAAGTGATAGTTTATCACCAGAAGAGAAAGAA

Fig. 13BA

GATGTTGTTACTCTAGTACGAGAATATATTGATGTCTTCGCTTGGAACTACGAGGATATGCCTGGGCTTGATCCCCAAGTGGCTATG
CATTGACTAAATATCAAACCAGACGTCAAACTTGTTAAACAGTAGCAGAGGCGATTTCGGCCCAAAATCATGGAAGCAATTGAAGCT
AAAGTCAAAAAACTCATTGAATCAGGATTTATCCGTGAAGAGCAACATCCTGATTGGGTAGCCAACATTGTCCTTATCCTAAAAAAA
GAACGAAAAGATTCGAGTGTGCATCGACTTTCGTGACTTGAATTCGGCTTGTCCTAAAGATGATTTTCCATTACCTATCACTGATGT
CATCATTGACAATACGTGTGGATTTGAGAGGATGTCCTTTATGGATGGATTCTCAGGATACAACCAAATTAAAATGTATCCTAATGA
CGAAAAGCATACATCCTTTTGAACACCTTCAGGGATATACTGTTATACAGTAATGCCCTTTGGGTTGAAAAATACGGGCGCTACCTA
TCAACGCGCTATGACCTCTATCTTCCAAAAGCATCTACGAAAGACTGTGGAATGTTACGTTGATGACTTGGTTGTCAAAAGTCGTGA
CAAGGGAAACCATTTACACGACTTGAAAACAATGATTGATCTTATGCGGATGCACCAGCTCAAGATGAATCCAACTAAGTCATTTTT
AGGAATGGCTAGTGGTAAATTTCTCGGGTTCATGGTCACGGTTAACAGAATTAGTTTGGACCCAGATAAAGTCAAGGCCATCCAAGA
GCTACCACCTCCCAGGAACCTTAAGGAGCTTCGAGGCTTACAAGGACGATTGGTGTATATTCGGAGGTTCATTTCTAACTTATCCGG
GAAATGCCAACCATTCTCGAAACTAATGAAGAAAGGAGTGTCCTTTACGTGGATGAGGCTTGTCAGAAAGCGTTCGAGGAGATTAA
GCAATATCTCTCCAATCCGCCGATATTAGTCGCACCAAAGGTAGGTAAACCTTTCTTAATATATATTCGGGCTACAGATCATGCATT
AGCAGGACTCTTGGCACAAGATGATGAAAATGGTCATGAACAAGCCATCTACTATCTGAGTAGGACATTATCGGGTGCTGAACCCCG
TTATCCTCTCATTGAGAAGGAATGCTTAGCGCTGGTCTTCACCGTTCAGAAAATGCAACATTACTTGGTTGGACAAACCATACATGT
CATTTCTCAGATTAATCCTATTCGGGTATTCATGACACAACCCAGTGTATTGAACTGGCGACTCGCCAGGTGGGTTTTGTTGCTTTC
CCAATATGACATCCACTTCAAACCTCAAAAAGCAGTGAAAGGTCAGGCTATTTGTGACCTTATGGCTAATCATCCTCTAAAAGAAAA
GGCCAAATTATACCAGGACATACCTGACACGACATACCGAAGCAAACGTCGTCTCTAGAGAACAAGTATGGCACTTCTACTTCGATGG
TGCAGCAAGGACAAGTTCTACTGGTCGGGTTATAGCTGGAGTGGGGGTTGTCTTTATCTCTCCCTAAAACCAGATACTCCCATGTGC
CATTTCTTTAACAGAGCCGTATTCTAACAATGTGGCAGAATACAATGCTTTGTTGGTTGGCTTAGATATAGCCAAACAATTGGGGGT
GAAACACTTGGAAGCATACAGTGATTCTCAACTCATTGTTAATCAAATGAAGGGAGAATATGAGGTTAGGAATGAAGACCTCGGTTCC
TTACCATACCGCAGCAATCGTATTATCCGATTCCTTTGAAGGCTTCTACATCAACCATATACCCCGTCTCAAGAATACCTATGCTGA
TGCATTGGCATCACTTGCGGCTACCCTAGCTCTACCGGAAGGAACTACCCAGCAAGTCACAGTGACAAGCAGGCAATTATTCAAATC
AAAGTATGCACTGCAGATCAATGCAGTTGAAGCAGAACCTTCAACATTCAAACCTAAAGATTGGCGATTTCGATCATCGATTATGT
CTTATACGGCTTATTGCCTAAAGACATCAAAGAAAAAGAATCTATTCGTAGACGAGCACCTAGATTCTACTATGATTCTCAATCCCA
GACTTTGTATCGAAAGTCATACCATAGACTTTTGCTTCGCTGTTTGTCAAATAGGGAAGCAAAAGAAGCCCTTAAAAAGGCTCATGG
TGGCATCTGCAGAGCTCATCAGCCTGAACCTAAGTTGTGGGATCGACTACGTAGATTGGGTTATTATTGGCCTAATATGGTACAAGA
TGTTGTTGTTTATGCCAAACGATGCCACACCTGTCAGATACATGCTAATTACATGCATCGACCACCCGTGCATCTTCATCCTTCAAC
CACTTCATGGCCTTTCGAAACGTGGGGAATGGACATTATTGGTCCAGTGACACCAGCCTCTTCCAAAGGACATCGTTTCATTTTGGC
GATAACTAATTACTTTTCTTAATGGCCGGACGCAATCCCGTTGAGAGAAGTCAAAATGAGTGATGTTGTTTAATTCTTAAAGCATCA
TATCGTATATAGATACGGCGTTCCGAGACGTATCATTCATGATAATGGCCCCAATTCATTAGCCAAGCTTTCACCCGATTCTGTGA
TAAATTCAGGATCAAGAATTTGGCTTCAACGGCTTATAATTCTGCCGCTAATGGGCTAGCAGAAGCATTTAACAAGACCATCGTCAG
AATTCTTACTAAACTGGTTTCAACGAACAAAAGAGATTGGAATGAGAAATTGGGTCAGAGTTTATGGGCTTATCGCACAACGGTTCG
AACATCGACAGGAGCGACACCATATTCCTTGGTATACGGAGGTGAAGCCGTATTACCATTAGGGATCCAAATTCCTTCTTTGCGGAT
AGCACTCACAATTGGTATGACGACGGAAGAGAGTCATCGCCAACGTCTTGAAGAATTGGAAGCGCTGGATGAAAAGCGGTTATTGGC
TCAGCAACATATTGAGCTTTATCAAGCTCGGATTTCCAGAGCATTTGATAAGAAGGTTAAATACCACACATTTAAGGAAGGCGACTT
GGTTCTTGCAGCTCGGCACCTGATGATTTTGAACTCCAAGAAGAAAGGAAAGTTTGAGCCAAAGTGGGAAGGGCCATTTGTAGTAGA
AACTATCTATTCGAATGGAGCCTATCGTCTTATCACTAAAGATGGCGACAAACTTATGATGCATATCAACGGTAAATTTCTGAAGAA
ATATTACCCGTAGACTTCATCATTAAATGTACCTTGCTACGAGAGAAGAAGCAAATAAAGGTAATGATTTCTTTATTTCATCTCCTC
CAAATTTCCCTCATTAATCCTCTTCAATAGGATAGTGAGACTATTATCGTGTTAATTCTATCTCTGATTGCTGATGGTCTTCTAATA
GTAACCTACTATGTGATGTGTTGCTTTCCTAACATCGTCATTTTCCCAAATGACCTTCGTTTTCCAAACTTAGGCCTACCAAGTGAT
GTGCCTTCGTTTCCAACATCGTCATACTTCTAAAGTCACTAAACGATGTGATTTTCCTAACGTCGTTATTTTCCCAAATGATGTTTC
TTTTCCAAACTTAGGCCTACCAAGTGATGTGCCTTCGTCTCCAACATCGTCATACTTCTAAAGTCACAGAACGATGTGATTTTCCTA
ACGTCGTTATTTTCCCAAATGACGTTTGTTTTCCAAACTTATGCCTACCAAGTGATGTGCCTTCGTCTCCAACATCGTCATACTTCT
AAAGTCACTGAACGATGTGATTTTCTTAACATCATCGTTTTCCCAAATGATCTTCGTTTTCCTAACTTAGGCCTACCAAGTGATGTG
CCTTTGTTTTCTTCGTCGTTGCTATTCTAAGCCATTGAATAACTTGATCATCCTAACGTTGTCATTTCCCCCTAAATGACGTTCGTT
TTCCCAACAAGTCTGCCATGTGTTGAACTTTGTTCTTAATACTTAGTATATTTTGAACCTCGTTATCACACATTTGATCTGAAGTC
TAAAAGAGACTAAAGATAGAAGAGAAATCTTAGCATTAAAGTCTAAGAGAAACTCTTCGACAACTCATCATACTGAGGGAAAAGTA
TGGCTAGTCCAACTCAAACGGCAGTTGGTAAAGACCACCCAAGTCCGTTGACAGCTGAGGGTTTGCTAAAAATCCTAAGTTAGAATG
CTTCAGTTATGCAAGAGAACAATATGTGGACAAAATATAAATTTTATTCATATATAATTGAAGATACAGAACTTAGAAGACTCGAAC
TACAATACGAGGTTCAGTTACAAGTTCTTTCAGCTACAATACGAGGTTCAGTTACAAGTTCTTTCAGCTACACTACGAAGTTCAATT
ACAAGTTCCACGACCTTCGAGATTGCACTACGAACCTCGTCGTAGCAAACGCGCTGTCTTGTTGTTGAAGTTCCATCTTCTGTTCC
TGGGCATGAAGTCTTCCCCATACCCAACATTTAACTTTGGTGCTTGTAGCACACGTTTACCTACTTGGGTAAACTGACTACTAATTA
AAACACCACAAGCTCTGAGCATAGGATCAGTACTTCTCCCATCTCCGAAGAACGTGAAGATGGCACTAACATTGTTGCTGACTCCTA
AAAGAAGCACTTCACTGAGCCTGTGAAGCTGCCACATAGACCGAAGTCTAGCAAAGGGACTGCATGCTTGGGGGTACATGGCATGTC
AAAACAGCAAGCATATTTGAATTTAAGATATCTCTTCCAGATTACATTCAAAAGTCCAACAAGGTGTCCAAACATGTCCTGATTTTA
ACTCTGGAACACTGAGAAACCCTCAAATGAGTGAGATACTATGAAGACCAAGAGATCAGGGATCGGGTCAGGAGAGTTACCTGAAGC
GACAAAGTCATCAACTTTGCCTACCTCACTGGCGACGATTATCGGAGCTTGGAGTCTAATAGGAAGCAAAGGTGGAACTTTTGAAAC
GGTTCGTTTTCTCCGAATTATTTTGGAAGCAAGGTACAGAAGAGGAAGATGAATCATCTCGAAAAGCAACTACCTATTTATAGGCAC
AGGAGCCAACCAAGTGGCTGGGATTCGTTACACGAATCCCTAAGCACCGAACCGCTAAAGGGTGCTGTGAACGAAGCGGCGCAATCA
ATTGCGTTCGTAATTAACGCCAAAGAAAACATGGCTCAAAACGACGCATTTAATACTCAAGACTTAACGTTGACGAAATGAAACAAC

Fig. 13BB

GGATTCTTGTGGATCAACAGTCTTGGAACTGTTAAAAAATTCCCACGTCGTTCAACGAGATTTATTCTCGTTCCTAAGTCAAAAATA
ATGGGGGTCGCTGTTTCAAACTGGGCTTAAGTATTGAAACTCGATTGAATTTGGATTCGAATCTCGTCTTCGACGAAGGTCGTTCCC
TTAGTTGGACTCAAGTGTTGAGACTTGATTAAATTTGGATTCGAACCTCGTCTTCGACGAAGGTCGTTCCCTTAGTTGGACTCAAGT
GTTGAGACTTGATTAAATTTGGATTCGAACCTCGTCTTCGATGAAGTTTGTTCCCTTAGTTGGACTCAAGTGTTGGACTTGGTTGAA
AAAGAATCCGAACCTCGTCTTCGACGAAGGTCATTTCTTGAATTATACTCAAGTATTAGATCCGAACCTCGTCTTCGACGAAGGTCG
TTACTTTAATTATACTCAAGTGTTGAAATTTGATTGAACTTGGAATCCAAACCTCGTCTTCGACGAAGGTCGTTCCTCTAGCTATAT
TCGAGTATTGAGATTTGATAAAAATTGGATCCGAACCTCATCTTCGACTAAGGTCGTTCCTTGAATTTTACTCAAATTTTGAGAACT
CGATTGAGATCGGATTTGAACCTTGTCTTCCACGAAGGTCATTCCGATAATTGAGTGCAAACACCAAGGATTAATTGAACGAGATTA
GGACCTCGTTGTTAGATCCTAGAGGGGGGTGATTAGGGTCTTATGCTAATCTAATCTGATTTTATGCCAATTAAAATTAATTAACAA
GTTATCCTAGCAAGTATGAAATACAACAATATATGAGCTAGGATAAAGGCAATATGAACAATGAAATATATCCTAGCAAAGAGATAT
ACTATGAGATATATATGTAAGGATATGAAACTAACACAAGGGTAAATAATATGAAACAAGATAGTGGATGATATAAATAATGAGACA
ATGGCGATATGAGCAATGAGCACAAATATAAATAAACGCCAAAGCACACTCAAACACAATCAAATGATCACGGAGTTCGGACCTTCC
GTCCTACGTCTCCGCTCCCCACTCCCGGGGAGAAATCCACTAACACAATCCGGTTTGGAAGCCGGAACTTCTACACACTCGGTTTTC
TAGCTAACCGAAAACTCAACAACTCACTCTTGCGAACCAACTCAACACCCTCACAAGTGTTGGACCTAGCCGTGTCTCCCTCAAGTG
CTCGGTTACAACCTTTCCCTAGGTTCGTCAACCGATGCCACTCCTCTTGGGACGATCCCCGACTCTCACCACACACTCCTCTCGGTG
TACAAGTGTATTACAAAGTGATCTATACAATTAGGCACAATAACAAGGTGTTTGTTCTCTAATACAAGGTGAGAACACAATGTAGGC
TCACACTCAATGTCACACAATCCCATAACCCAATTATATAATGTATGCAAATACAATAAGCTCAATGGTTGTGTGTGTAAACAAAGA
GTAAATCAAATCAAACTAAACTCAAATAAATTCTAGCTTAATAAAATGATAATCAAACAATTATATATAAATGTAAAGCTAGATTGA
GTTTAGAAACACTTCTCTAAAGATGACAAGAGAGAGGGAGAAGAGTTGAATGCCCAAACACCAAAGAATGATCTCCTCAAGCTCTTG
TGAAAGTTTCTTCATAAACAAACTCTTGAAACAAACTTAAAAACTCTTAAACAAACTTGTAAAACTCTTTTTAAAACTATCTTAAAC
ATCCATGAGAAACAATGAAAGTTGAGGGCTTTTTATATCCTCTTAAATCAGCCATAAACTCCCAAAAACCGAAAATATCAAAAACTA
GCCGTTACTAGCCGTTATAGGCTGAAAAGACCAAAATACCCCAAATTCCAGCATTCTGGAAATTTGCGTATCTGACATTGTAAAATA
AATTAAAAATAGTAAATCAATTCTAAAAATCATGAAATGTTGTGTAAAGGTTCTAGACATGTATATGAACATGTTAGAGAAAGAATT
TATGAAAAATAATTTCTCATTTGAGAGAAATAAATGTTTGAACACAGATATACAGTTTCTGAAAATCTGCTGACATACACGATTTTG
TAAAATAAATTGGGCATAGTAAATCAACTCCAAAAATAGTAAAATTTTTAGGAAAGTTTCTAAACATGTAGATAAACATTTAAAAGA
AAGAATTTCTTAAATATCACTTCCAGTAAATCAACTCTAAAAATAGTAAAATTTTGAGGAAAGTTTCTAAACATGTAGATAAACATG
TCAAAGAAAGAATTTCTTGAATATCACTTCCCATTTATGAAAACTCATCTGTTTTGTAAAACATGTACGAACATGTGCACGAACAAA
AACATGATTTTGTAAATTTCATTAAACATAACAAATCAATTCCAAACTTGATGAAACTTTGCAAAATGTTTATAAACATGAAAACAA
ACATGTTACAAAAATAAAATTTTCATTTTCATTTCTCAATTGTGAAAACTCATTATTTTGTAAAAACATGCATGAATATGAATTTGT
TAAGAACTTGTTTTTGACAAAAAGAGTTTAAACGCATATTGAAACTTTATGAAATGTCTTCATAAACATTATAACACATGAATATAA
AGTAAACATGGTCAATAAAACAATATCACAAAGTTTTCCCAAAATAGCTCATTTTATGAGAAAATCCAATATTGTGTGTGTATATGA
TATTGAGCTTAGAGTATTAAACACACATAATATAAACCTATACTAAATATACCCAAGCTTGATGAAGGTCTTCAATGAGCATGACTT
AGTAAACTATACGGAAGAAGCTTGTGATTGGATCTTTAACTTGAATTGACATTGCTTCACTCCACAATTCCGCCAACCTCCATTTGA
TATGATCGTTAAGGCTCGATTCCACCCATTCTCCAACAACGTTGTTTGTCTACAATACATAGGAAAATACAAATACTAGACAAACAA
CATTAGTGGTAAATTATTTGTTAAACATCATCAAAACAAGAAGGCCAACAATCTCCCCCTTTTTGATGATGACAAACAATTTACAAA
AAGGATATATGCATGAAAGGAAATGAACATACAATGTATAATATATCATGCATATAAACAAGAAAGAATATACTCACAATATTTCTC
CCCCTTTGACAACATCAAAAAGGGACAAAAGAAATAAGAGAGCGAAAGCTCCCCCTATCAATAAGCACGGGTGAGTATCAAACATA
AAAAGATATAGGGATTGCTCCCCCTATCAAAAAGCCATATAGAATATATGCAATGAAGATCATGGCAAAACATATGTGAGCAAGCAT
ACATGAATATGCTAAAAATTTACTCACATACATGAAGATAATGAGAACACACATAAATATGTCAATATGAAATTAGTGTCTCATTAA
CACAAAAAAAATATAAAAACCATATAAAAGAATAGATTTATGAAATCAAAAGAAGAGGAACATGAGAATCATGCAAAAAGTTTTCAA
ATGAAAACAATTCAACCAAAAGAAATCATAAATCAAAGTTTATATTAAAAAAACAATGTTTGATCAATAAAGAAAAAATTTTCTTTACA
TAACTTGATCAAACCACTCATAGAATACATTATAAAGCACGAATAGATGATCCATTAGCACAAACACATAAATATCATCATATAAGT
GAATTATAATGAATTCAAAAGCAACAAATCAAAACACAATTTTTAAGAGAGGCAACAATTATATCAAGCTCTTGAGCTTGTTCCAAC
CCATATAATCATTTTAGCATCCGGTAAACTTGATTTGGGAATAAACACCCAATAAACCCGAAGGGTTATATAAATACAAACCTCTCA
TCAAAACAAAACAAATAATCATGAAAACAAAAGATTTTATCAATTATAAATTGTTTTCATATAAAAAGATTTCAAAGCATAATTTTC
AAAACCAAGATAAAGAAGGATAAATAAGAATACTAAAATTCTTGGTTTAAAATTTAAATTTGTACGAGAGATTCAAAATGATCCTAT
AAACACAATGTTCAAACTCAAAAATTGAAAACAAGATGTACTAACTAGAATGATGTTATAGAAAAATAATCTTGATAAAATTTGTAT
CAATTCATAAACGATGAAAACATGAAAATCTATGAAAGAGAATCATGAAAAAANNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNN

Fig. 13BC

NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNGACCCCACTCCTC
TTGGGACGATCCCCGACTCTCACCACACACTTCTCTCGGTGTACAAGTGTATTACAAAGTGATCTCACAAGATAGGCTCAATACAAA
GTGATTGTTCTCTAAACAAGGAGAGAACTCAATTAGGCTCAACTCAATGTTACTATCTCTCACAACCCCAAATATATTATGAATGCA
AATACAATAACCTCAAGTGGGTGTGTCTAACAATGAGATTAATCAAATCTAAACTCAATATAAAACTAGCTTTAATAAGATGATAAT
CAAACAAATAAATATAAAGCTAGAAAAGAGTTTAGAAAACTTCTCAATAGATGACAAGAGATGGAGGAAGAATAGTTGATTGCTCAA
ACTCCAATAGATGATCTCCTCAAGCTCTTGTGGAATTTTCTTCACAAACAAACTCTTGAAACAAACTTAAAAACCCTTCAACAAACT
TGTAAAACTCTTTTTAAAACTATCTTAAACATCCATGAGAAACAATGAAAGTTGAGGCCTTTTATAGCCTCTTAAACCAGCCACAA
ACCCCAAAAACCGAAAATATCAAAAACTAGCCGTTACTAGCCGTTATAGGCTAAAAAGACCAAAATACCCCAAATTCCAGCATTCT
GGAAATTCTGGAAATTTACGTATCTGGTTTTGTAAAATCAATTACAAATAGTAAATCAACTTCAAAAATTATTAAACTTTGAGAGAA
GGTTTTAAACATGTAGAAGAATATGTTAGAGACAGAATTTCTGAAAAATAATTTCTCATTTGAGAGAAATAAATGTTTGAACACAGA
TATACAGTTTCTAAAAATCTGCTGACATACACGATTTTGTAAAATCAATTGGGCACAGTAAATCAACTCCAAAAAATAGTAAAATTTT
TAGGGAAGTTTTTAAACATGTAGATAAACATTTAAAAGAAAGAATTTCTTAAATATCAAAACATGCACGGACATGCACGAACGAAAA
ACATGATTTTGTAAATTCCATTAAACATAACAAATCAATTCCAAACTTGATGAAACTTTGCGAAATGTTTGTAAACATGAAAACAAA
CATGTTAGAAAAAGAATTTCTCAAATTGAATTTCCATTTGTGAAAACTCATGTATTTTGCAAGTATGTCCAAAACATGAAAACCCAA
AACCATGCATGTATATATATAACTATATATATACATAGAAACCAAATACGTTTGTGTATATGATATTGAGCTTAAGGTACTTAACAC
ACATAATATAAAACCTAAACTAGATTACCCAAGCCGATCTTGATCTTCAATAAGCTTGACTTGGTACACTTTGCGGATGAAGCTTGA
ACTTGATCTTTAACTTGAATTGTATGTTGCTTCACTCCATAATTCCGCCAACCTCCATTTGATATGATCGTTGAAGCTCTATTCCAT
CCATCCTCCAACTACGTTGTTTGTCTATAATAAATAAGAAAACACAAATACTAGACAAACAACATTAGTGGTAAATTATTTGTTAAA
CATTATCAAAATAAGAAGGCCAACAATCTCCCCCTTTTTGATGATGACAAACAATTTACAAAAAGAAATATATGCATGAAGGAAATG
AATATATAATTTATAATTCACATGCATATAAACAAGAAAAGAATATACTCACAATATTTCTCCCCCTTCGACAACATCAAAAAGGGGA
CAAAAGGATGAAGAGAGCGAAAGCTCCCCCTACAAATAAGCACGGGTGAGTATAAAACAAGTATAGGGATTGCTCCCCCTATCAAAA
TGCCTTAATGAATATATGCAATGAATGCTAAGGCATACATATGTGAGCAAGCATAGATGGAAAGTATGCTAAACACTCCTCACATAC
AAAAAGACAATGAAGACACATAAATATATTATTATGAAGATAGTGTCTCATTACACTAATATAAAAACCATGTATAAAATAGATTTA
TGAAATCAAAAGAAAAAGAGCATGAGAATCATGCAAAATATTTTCAAATGAAAACAAGTCAATCAAATAAAATCATAAATCACAAGT
AAATCATACAAGAACATAAAACCAAATCATACAAATTCTCTTCGATCTCTTTGAACTCCTTAATCCGTTGCTTAGTCTCAAGCAATT
GATGGTTAAGTTCAAATAAGGAGTCATCCCTTTGCCGCAAGGTTTGCATATCCCGTTCTTCAGCCAAAGGATAAAGAGATCGAGACC
GATGATTTTCCCATTGGTTGAAAAGATCTTTAACCTTGGTCAGGTGAAACCAATACGGTAATACAGCAAGGTCAGAGGTTAAACTCT
TCATCAAGTCAAAGAAAGGCACCAGCACCTCTTTAACATCTGCAAAATTTCCTCCATGGTCCAAAACTTGAACGGAAGATTCTCTCA
GGATGCTGAGGAAGTTCTCTGATATTTTTGATACAACGAAAGTTCTCGTCGAAGATGGAGGAGAAGCATGTGTGCTACTAGAGGACA
CCGTTGCATGAGTAGCGGCCAAAGAAACTCTAGCTGCTGTGAAGACTGGCGGCGCATGGCATACGGTAGGAGCGTCAGCAGTTGTAG
CAACCATTGTAGTAGTGGTAGGAGCAGCTGCGACTGCAGTACTTGGTATGATGCAAGTCTCGGTCGTCATAATGGAACTGGTAGACA
CAACACTTATATCCATAGTGGCTTCAGCTTCAGCTATGGTGGTTGGAGCTGATTCATCTCCCTCAGCTTCCTCAGGTCAACAGTCG
GCTTATCAGCTGGCCTGATTCCATAGCTAAACTTGGAGGTACCCTACTTTTAGCAGGGTCATCAAAAGCCGGTCTCACCTCAATAC
CTACATCGGTAAAGGTAGTGGAATATGTGGAAACAACTAAGCGTGTCAAACAAAGTCGTTAGTATCTTAGAAATCCAGAATGGTAAA
TGACTATACACCTATCTTACCAGGATCAGCAGGAGTGAGTACTCGGCACCGAACGCAGTCCAGAGCGGAGTCGAGCTAAAGAAATCT
CATCATCAAGCTCCGAATCCGTCTCAACACTGAGTGACTCCATCAAAGGAGTCATGGGCGGAGAAACATTACGCCTTGGTTTTTTG
GCGACACGTTTAGACTTGCGCATTCGGCCGATTTCCTTAGACTTTTCCCCACTTGTCTGGGGCCTCTTCTTCCGCAGTTTGTTCTG
AATAAGAAGTATCAGAGGGAAACAAGTCAAAATTAAGACTAGTCAAAGCTGGCATACCGGTAATCCCTTAGTCGGGATGTGGTTCTT
CAAGAACTGGGATTGTCGATGAGAGCCTTCAGCAGTAGACCCACGTGGAGCAGACTCGCAAGGCTCGTCCATGGAGGCAAAATCCT
CAAATCCACCAAGATTTGCTCCATCTTTTAGAGTGTCTCCAATATCGGAAGCAGCAGGCATGTGGCTCCCGTACTCGTCAACATGAG
GAGATTTATGAGATACACTCTCATTTAGAGCCGCATCTATCTCTTCTTGAGTCTCTTGAGGGCTAGGAGGAGTGGTTTCCTCTACCC
TAACACTCTCTTCAGCATGCAGGAACTCTTTAAGCCCTGGTATATGGCTTCACTTAGAAGCATTCCTGGATCTGTATCAGTGTCGGA
TATAATGCAACCCCGATGAATTTATGTTGAAGTTGGGAATCACTGCGTTTGCCATGCAATGCCACTTGCAATAAGCAAGTGTTGTCC
GAAGCTGTGGATTTTTTGGTGGAAGCAAGAAACGAGCACCTGTGCCGCCGGCAATGGTCTAATACTAAGCTCTGGCCCCAATGATTA
AGCTACAACCCTCAGATATCAGTTGAGTATTAGGATTACTAACGTACAACTGGGTGTAGCCGAATTGGCGAGCGAAGCGACAAAGCA
AGTAAGGCTCCAACACGCACACTGGGCCGAAGCGATAAATATGATACCCAGGGCGAATGGTCATAAGCCACATGAAGAAGCCAAGCG
ATAGAGAAGAATAGCCCTGACCATTGGATGCATCCACAAGGGCCTGTCCGTAACTGGTTCCGGGGAAATGAGGAAAGCATCGATTGA
ATTCCCATCTCTTGTGGTCGCGGAGAATGCGCCTCACCAAGGCCAAGTAATGGTGCTCCCAATCGATTGAATTCCCATCTCTTGTGG
TCGCGGAGAATGCGCCTCACCAAGGCCAAGTAATGGTGCTCCCAATCTAAATTCTCCAACCACTGAATGAAAGGAATGACTTCACAT
TCTCTACGAGCAGAGGGCGTACCCATAAGGGTTGACAATGCAGAACAACCCATGCCATGAAATAAGTGTAGGGCAACCCTACCTTT
GGGTTCTCGTTACCTCGACAAAATTGGTAACATAAGCTCCGTAATCCATAATGAATGTGGGCGATCATGGCAGGGAGAAGGGCATAA
GAACGACCATGTGCTAAACATACGGCAATGAACACCACTTCCATTGGCAATGAGTCAAAACTTCCAGAAACAACGATGACTTGATGC
AGCCATAGCATGAGATACCCTTCCAGCAAAGCCTTGGAAGAAATAGGCTCTCCACCTTAAAAGAAATAACTCTCAAAAGTGGTACCC
ACAGGGTAACCTTGTTCATCTGATTCCGACACCCGATGCATGGGAGGATAAGTAAGTACCCATCGCGACAATTCACTTGCGTCACAA
GGACCCAAGGGAACCACCAGGTCATTTTTATGCTCCAAGTTCTTGAAGAGATATCGAGCCCAGATGCTATGGCTGAGGAGTCTCTCA
CCCTTCTTATTGAGCCGTCCTTCCATATTCATACAAATGTGGTAATGACACATTAACTCCCATAAGGTCTCTACTACTTGGGGTTGC
TCCTTTTCTAGAGCAACTAACTCCCGTTGACCTAGGATATACTCCTCATACGGATAATTCCCGTTTGGTAGCCCGGAGACTTCTTCC
ATCTCGTGAAGAGCAATCCCCATCTCTCCATCAGGAGTAAAGAAAGTATGGGTTGTAGGGTTATACAACTCCAAAATACCAAAGAAC
TGGTGGGAGTTATTGATCAACCCGAATTGTGTCGCTCTGATGGGTGCATAAAGACCAAACTTTTGAGAACTGGTGGGAGTTATTGAT

Fig. 13BD

CAACCCGAATTGTGTCGCTCTGATGGGTGCATAAAGACCAAACTTTTGTAGGTCTTCCTGGTTCTCCTGCAAAATATATTCAGTGAT
ACGAGGCCACCATTGTGTAGGACTCTAATGAGACCAGCCTGGAGTTCTAAAGTCCTTAGCAGGGAATTGACCCTTTCTCCTAAAAAA
TGCACGACCAAAGGTGTTAGCCTCCTCAGCGGTCTCACTAATCGAGAGTTCTTTTTAAAAAAGCCCAGTGTGAAATCCGGTGATGTA
ACGACCACCACTATCTATCTTTGTGTCACTACGAGAAAAGTGGCCACATATGACCCCGTCTTGTACTGGGGTTAAATCCCAGTCCAT
TCTCCTGGGAGCCAAGACAATCTTCAAAGCAGTAAGAGAAATGTCACGCTCCATCCGAGGCAAGAACAAGTTTCGTCCGTTTATAGT
TCTAAGCCATTCATATGTCCCGATATCTAGCAAGTCAGGATCCTCCGAAGAGTCTTCGAACAAGAGAACAAGCTTCACAATAGGTTC
ACAATTGATAGACTCTAAGGGAGCATCAATGATCATACGCCTAAATATGGAAATTGAAGGGTCAGAAAGAAGATCCTGAAGGACCCT
AGAGGGGGGTGATTAGGGTCAAGAGGCTCTAATATGCAATTAAAAATCAGTACAAACAAACCACAGTAACAGAAGTGCAATAATAAA
GAAAGACATAAAGTTAGGAATCCGTTATCCTTGACGCGCGATGTGTTAACGAGGTTCGGCCCGCTGACCTACGTCCCCGCTCCCCACT
CTCGAGGAGAAATCCACTAACACATCCGGTTTGGAAGCCGGAACTTCGTCTACACAATGATCCCACAAGATCTCTCTCTCACTACAC
AGTTGATCTCACAGATCACACTCCTTCACAGTCGATCTACACAAGATCTCACTCACAGCAGCAGAAGATAAATGCAAGACACTCTCT
TTACACAAGCCCCTATAGCAAAGAGAAGAGTACTGAAGCTGGAAGTGAAACACACACAAGAACTCAGAAGAACAAGTTTGATTTGA
AAATTTTCTCAGGAAGAAACAGAGCTCTCTGGTTCTCTTTCAAACGTTAGGGCTTAGGGAACAAGAAGCAGGCTTGGGGGTTTTTAT
AAAAGAGTTTAAATCAATAAAAACAAAAACCCAATCTTCCTATTTAGGAAGATAATCTACTTTGCAGGTTGTGACCTCAGACTGTGC
CAATCACTAATAAGTGAAAGCACAGGAGTCGAGGCGAAAAAACGACCGTTTTAAAAAATCGCGGCTGACCAAATCGGTTGACCGAAGA
AATAATCGGTCGACCGAAAATACCGTCGGTCGACCGACCGAAAAATTCGGTCGACCGCTGACAGCTAAAGAAATTTGGAAAAACAAG
CAGAGCCTCGTCGGTCGACCGGCACGGTCGACCGATTAGAAGATTGAAAATTCGAATAGTATTTTGTGAAAAACGCTTAAAAGCACA
AGTTTAAAAACGTGTGTGTGATTCCCAATAGCTTCAAGTAAACTCAGTAACTCTTTGCCTACATTCTAGCACTAGAGAGAAGAACAA
AAGAAGGCTAATATCCTCATATTGAAAGCAATACTTGAGCTTTGATATAGCTTGAATCGGATGAAGCTTTTATATGACTTTGTTGTT
CTTGAAATAACGTTGCTTCATCTTTTTGGCCTCCTCCTCCTTTAGATGTCTTCGTTTTAGCGTATATTCCATCCATCCTCCGTTAAT
GGCACTAACGAGCTTGACAAATGATTTTACTACATTTACACTCAATAAGCCATTAGTACCGATAATGGTGGTTGTAAGAACATCATC
AAAACATAAGGGCTAACAATCTCCCCCTTTTTGATGATGACAACCAACCATTATATAAGAGCAAAAATAAGATAGCTTATAGATAGG
TGCTCCCCCTATCTATGAGCTCCCCCTAAATATATGCAACAAATGAGGAGATTTCTCTCCCCCCTTTGTCACCATCAAAAATGGGGTA
AAGAGAAATGCCAAATGCAAAATGCAACTAATCAAGCAAGCAATGTAGAACTTTCACATAGTGCATAAGCCCAAACCATTTCTTATG
CGACAAAAATCATCCTCTCCAAGAGGCTTAGTAAATATATCCGCTAGTTGAGATTTGCTGTCAACAAATACTAGGGATACATCTTGT
CTCTCTACATGATCGCGTAAGAAATGATGGCGCACGTCAATATGCTTAGTTCTAGAATGCAAAACCGAATTTTTGGAAATATTTATG
GCACTTGTGTTATCACAAAAGATTTTAATATTTTGAAAATTCAAATCATAGTCAACTAAACTTTGTTTCATCCATAAAACTTGAGCA
CAACATAAGCCGGCGGCAATGTATTCCGCTTCCGTAGTGGACAATGCAACACAATTTTGTTTCTTGGAAGCCCAAGAAACAAGGGAA
TTTCCTAAGAATTGGCATGTTCCACTAGTACTCTTGCGATCTACCTTACATCCGGCAAAGTCGGCATCACAAAAACCATATAAATCA
AAAGTGGTGCTTTTTGGATAAAACAAACCAAGCTTAAAAGTTCCATTAACATACTTAATGATCCTTTTAACCGCAATTAAATGAGAT
GCTTTTGGAGAAGCTTGAAAACGTGCACATGCACATACACTAAACATGATGTCGGGTCTACTAGCGGTGAGATAAAGAAGACTACCT
ATCATACCTCGGTATAGTTTTTGGTCCACATCTTCACCACTCTCATCCGCATCAAGCTTAACACTAGTACTCATGGGAGTAGGCGCA
TGCTTAGAATTCTCCAACTTAAATTTCTTCACCAATTCCTTCGCATACTTGCTTTGTGAAATGAAGATCCCATCCTTAGTTTGCTTG
ACTTGGAGCCCGAGAAAGAATGTAAGCTCTCCCATCATACTCATCTCAAAGTGATCCTGCATAACTTTAGAAAATTCCTTGCACAAG
GATTCATTAGTAGCACCAAAAATAATGTCATCCACATATATTTGAACCAAAATGAAATCATTTTTCCTTTTTCTCACAAAAAGTGTG
TTATCAATTGTTCCTTTTGAAAAACCATTTTCAATAAGAAAACTAGAGAGGCGAGCATACCAAGCCCTAGGAGCTTGTTTCAACCCA
TATAAAGCTTTTTGTACCCGGTAAACATGATTAGGAAAAGCATGATCTATAAAACCGGGGGGTTGCTCAACATACACTTCCTCTTCT
ATAAAACCATTTAAGAAAGCACTTTTGACATCCATTTGAAATAGTTTGAAATTTTTAAAACTAGCAAATGCCAAAAACATCCTAATA
GATTCCAACCTTGCAACCGGTGCAAAGGTTTCATCATAGTCTATGCCCTCCTCTTGATTGTATCCTTGGGCAACCAAACGTGCTTTA
TTTCTAGTTACAATGCCATGTTCATCAAGTTTGTTTCTAAAAACCCATTTTGTACCAATAACACTAGCATTGTTAGGTCTAGGAACT
AACTTCCAAACTTCATTTCTTTGAAAATTGTTTAATTCTTCATGCATAGCCAAAACCCAAAACTCATCATTTAAAGCATCATTAACC
TTTTTAGGTTCTAGTTGAGATAGAAATGCAACATTACCACATTCACTCAAGGCTTTTGAGCGAGTTATAACTCCTTTTGAAGGGCTC
CCAATGATTTGTTCCTTTGGGTGGTTTGATGTGAATTTCCAAGCTTTAGGTTGTTCAACTTGATCTTGAGCATTTGTGCAATCTACA
TCCTTTTGAGCTTCTATAGAGGGAGTGTCATTGATTTGCAACAAGTCCAATCCTCCCTCAATATCATCATCATCATCCTTCCTAGGC
AAAACAACTTGAGAGCCAACATTAGTCTCATCAAAAGTAACGTTTATAGACTCTTCAACAACGAGGCTTCGTTTATTGAAGACCCTA
TAAGCCTTACTTCGAGTTGCATAACCCAAGAAAATACCAACATCAATTTTGGAATCAAATTTATCATGGTGATCTTTTTGTATTTAAA
ATAAAGCATTTGCAACCAAAGACACGAAAATAACCAATGAAATGAGTTTTTCCATAATAAAGTTCATAAGGGGTTTTCTTAAGCTTT
GGTCTAATCAAAACACGATTTAAAACATGGCAAGCCGTGTTGACGGCTTCCGCCCAAAAATATTTGGCAAATCAAAAGAATTAAGC
ATAGTGCGTGCCATCTCTTGTATGGTGCGATTTTTCCGTTCAACAACACCATTTTGTTGTGGTGTTCTAGGAGCGGAAAACATATGA
GTAATACCATGATGAGCACAAAAATCATAGAAAAATTCATTTTGAAATTCACCACCATGATCACTTCTTATTTTAACAACTTTCAAA
TCTTTTTCATTTCAATCCTTTTAACATGATTAGCAAATTCTTCAAAACAATCATTTTTCTTAGCAAGAAATATTGTCCATGTAAAA
CGAGAAAAATCATCAATAATCACAAAAACATAGTGTTTGCCTCCAAGAGAGGTAACACGCATAGGACCAAATAAATCAAGATGAAGT
AATTGCAAGGGTTTAGAAGTCGATACCTCATGGATGGATTTGAAACAAGATTTTGTTTGTTTACCTTTGGCACAATCCTCACAAATT
GTATCTTTTATGAAGTGCAAGTTAGGTAGCCCTTTCACAAGATTCTTCTTAGACAATTTTGAGATTAGCTCCATATTTGCATGTCCA
AGTCTCTTGTGCCAAATCCAAGGATTTTCATCAATTGCCGCAAGACACTTTACATCTTGATTCACTAACTCATTCATCTCAAAAATG
TAAACATTAGACTTGCGATTTGCAATGAAAACAATTTTTCCATCCATACTAATGATGCATTTGTCCGGTTTAAAAGAAATATCAAAA
CCTTTATCACTCAATTGACTAATACTAAGAAGATTATGATTTAAACCACTTACTAAATAAACATCTTCTATTATGGTGACGGTTTC
TTACCAATGGAGCCAATACCAACGATTTTGCCTTTCTCACCTCCACCGAAGGAGACATTGCCTCCTTCAATCCTTGATAGGGTTGCA
AATAACTCTTTGTTGCCCGTCATATGATGTGAGCAACCACTATCAAGGTACCACATCTCCTTACGTCGTTGCCGCGACGTTCCCTAC
AAAAGAAGAAGATGAAGGTGTAGTAGCTTTAGGTACCCATGTCTTGGGTCCTTGGTGGTTAGTAGTCTTGGTACCTTTGGGTACCCA

Fig. 13BE

TATCAAACCATAAAAATCTTCATTGTCTTTGATTCTACAATGAGTAGAAATATGTCCATGTCTCATACAATATGTGCACACAAAATT
TCTTTTGTATGCATGAGAGTGAGAGCCATAAAACTTATTTCTACCATGATGATAATTAGCAAAAACATGAGTGGGTCTAGTCCTACA
ACCCTCAATTTCTAATTTTTCAATCTTTGATCTTAGTTGCTTATTCTCGAAATCGAGATCTCCTAGCAATTCATCTTTAAGAGCAAG
AGAGGTTGTTAGTTGTTCTAGCTTAATATCACAAGAGGCATGTAATTTTTTGAAAGAAGAGTATTCCTTAGACATTCTTTTAAATTC
AAAATTCAACTCTTCTAAAGCCATAGCTATATCACATTGCATATAGAAAGATTCACTTTCGGCCTCGGATATTACCTCATGTTCATT
TGCCATGAAACAAACATTTGGGTCATGAAGAGCCAATTTTGCTCCTTCTTCATCACTCTCCGAGTCACTTGGTTCGGATTCTTCCCA
TCCGGCATACATAGCCTTCTTCTTCTTGTACTTCATGTACTTTTCTTTGAGCTTGGGGCAATCCTTAGCCGATGTGACCCGGTTCATT
GCATTCAAAACATTTAACTACACGAGATGAAAACTTGTTGTTAGATCGGGGATTAAATTTTTTGTTCATTTTAATAAGTCTAGAGAT
TCTTCTAGAGAGATGAGCCACTTCTCTAGAAAAATCAACTTCACTATCCGACGACGAAGATGAGTTGTCACTAGCTCCTTTGAGAGC
TATGGTCTTCAACTTTGGTGACGGCTCCTCAACTTCACGTGATGGCACTTCCTCCTTCTCCTTCCCTTTTAGCTTCTTCTCATGCAC
CTTGAGCTTTCCGATAAGGCTATCAAGAGCTAAGGTAGTAAGGTCATGAGCTTCCTCAATGGCCGTAGCTTTGGGCTCCCATGCCGG
AGTTAAGGAGCGAAGTATCTTGTAGTTCATCTCTTGAATGGATAGTTGCTTATCTAGACCATGTAATTCATTGATGATATTAGTAAA
ACGAGAAAACATAGCATCAATGGATTCATTTGGAAGCATTTTAAATAGCTCATAATCATGCATAAGCCCACTAATTTTAGATTCCTT
AACTTGGGGGGTTCCTTCATGTGTGACACATAATTTTACCCAAATTTCGTATGCGGTTGCACACGTGGAAACTCTATTATATTCATT
AGGGGAAAGACCACAAATTAAGGCGTTCATAGCCTTAGCGTTGAGATTACCTAGGTGCCTTTCTCCATCGGTCATGTTCCCGACTTT
GGACTTTTCCTCATATTTCTCTTCTATGAGCTCTAGAATGTCAAGGTCTATGCAACGAAGCTAAATTCTCATTCTAGCCTTCCAATA
GGCGAAATTTGTCCCGGTAAAGAGAGGTGGTCTAGTTGTGGATTGTCCTTCTAACATATGCATATTCAAAGAGGCCTCCATTAGATC
TTTTCTCTAAGGTTGTTAAACCAAAAACTGATATAGAGACCAAGCTCTGATACCAATTGAAGGACCCTAGAGGGGGGTGATTAGGG
TCAAGAGGCTCTAATATGCAATTAAAAAACAGTACAAACAAACCACAGTAACAGAAGTGCAATAATAAAGAAAGAGATAAAGTTAGG
AATCGTTATCCTTGACGCGCGATGTGTTAACGAGGTTCGGCCCGCTGACCTACGTCCCCGCTCCCCACTCTCGAGGAGAAATCCACT
AACACATCGGCTTTGGAAGCCGGAACTTCGTCTACACAATGATCCCACAAGATCTCTCTCTCACTGCACAGTTGATCTCACAGATCA
CACTCCCTCACAGTCGATCTACACAAGATCTCACTCACAGCAGCAGAAGATAAATGCAAGACACTCTCTTTACACAAGCCCCTATAG
CAAAGACAAGAGTACTGAAGCTGGGAAGTGAAACACACACAAGAACTCAGAAGAACAAGTTTGATTTGAAAATTTTCTCAGGAAGAA
ACAGAGCTCTCTGGTTCTCTTTCAAACGTTAGGCTTAGAGAAGAAGAAGCAGGCTTGGGGGTTTTTATAAAAGAGTTTAAATCAATA
AAAACAAAAACCCAATCTTCCTATTTAGGAAGATAATCTACTTTGCAGGTTGTGACCTCAGACTGTGCCAATCACTAATAAGTGAAA
GCACAGGAGTCGAGGCGAAAAACGACCGTTTTAAAAAATCGCGGCTGACCAAATCGGTTGACCGAAGAAATAATCGGTCGACCGAAA
ATACCGTCGGTCGACCGACCGAAAAATTCGGTCGACCGCTGACAGCTAAAGAAATTTGGAAAACCAAGCAGAGCCTCTTCGGTCGAC
CGGAACGGTCGACCGATTTGAAGATTGAAAATTCGGTCGACCGTATCGGTCGACCGACGACAATCTGGAAAGATACTAAGGGATGGC
CATAGGATCGGTCGACCGATTTCTGATATTTTCCAGAAAACAGGTTTTTGACCAACTTGAAATATTTGCAAGATATTCATTTGACCT
CTGAAAATTCTGAAACTTTGTAAAATGTTTTTAATACTAAAAACAAACTGTTTGGAAAAAGAATTTTGCAGATAGGTACTCATACTT
GTGAAAAATAGTGTTTTGTGAAAAAACGCTTAAAAGACACAAGTCTAAAAACCTGTGTGTGATTCCCAATAGCTTCAAGTAAACTCA
GTAACTCTTTGCCTACATTCTAGCACTAGAGAGAAGAACAAAAGAAGGCTAATATCCTCATATTGAAAGCAATACTTGAGCTTTGAT
ATAGCTTGAATCGGATGAAGCTTTTATATGCCTTTGTTGTTCTTGAAATAACGTTGCTTCATCTTTTTGGCCTCCTCCTCCTTTAGA
TGTCTTCGTTTTAGCGTATATTCCATCCATCCTCCGTTAATGGCACTAACGAGCTTGACAAATGATTTTACTACATTTACACTCAAT
AAGCCATTAGTACCGATAATGGTGGTTGTAAGAACATCATCAAAACATGAGGGCTAACAGATCCACTTCTTCTAGCCCCCGTTCTCC
GAACAAACGAATGCTCTCAAGGGCATAGTAACAAGGATGAATTGCGTATGTTTGAGTACCATCCGCTCCGAGATCGCCACCCTGAGG
AAGTGGAGTAGAAGGATATATGACTGCACAAAAAGACAAACAAGATTAGTCTCAAGCAGCAGTTACGGCCTAATAATACGAAGGTCA
TTCTGGCAACGAACGTCGAAATTCATTCGAATGATGAACCTCGTGTTACAACGAAGTGTTAAACTTCATTGGCCAAGCAAGCTCATT
CAACCTCGACAAGGATAACGAGGTTCACCAGTTCAACGAGATTCGTTGGAGAACACGAAGTTCATTATTTGAAAACGAAGTTAACCA
GCCCAACGAGCGTGGTCGACGAAAAGACGAACCTCATCATATAAACGAATTTCATTTAACAATTCTAGAGGATGTAGAACCCCGTAA
ATTTATTAATGAATATATTGAGTTATTAGTGGTAAACATTTCTTTTGAGATGAATAACTATATATATGTTAAATAAATGTGATAAAT
AGTGTTTGGGAGCCTAGCAAGAATTTCTATGTTAGAGAAATCAAGGGGATTGATCAGCATGTGATAGAAGGCATAGCAGGCAGTTGT
TCTGCTGTGCGGTCGACCGCGATGTGCGCGGCGGTCGACCGCACAGCAGTCGGGCACACAGGAGACTTTTCTCCTGCTGTGCGGTCG
ACCGCGCAAGGCGCGGCGATCGACCGCACAGCAGCAAAGACTTTTTCTGTGTTCGGTCTTAATGCGTTTCGAGTCGGGTTCGGCTC
GGGTTGTGGGGTTAGTATATATACTATCATACCCTAAAGAGCCCCATTTCTCATCTGAAATCAGAACCCTAGCCCCCTCTCTCCCCC
TCAAACCCTAGTTCTCACTTCTTGGTGATTTGGCAGAAGCCTTGAAGGGATTTCCAGCGAACTCTTGGTGGATTCAGCGTGGGGAT
CATCTTCCTTCAGATCTAGGGCTTCCGTTTCATCATAGGCGAGTAACATCTCGCCCAACTTCACCCCTCTTTGTTTTATGCTTAGAT
TTGAGTTTTTAATCCGGTTTTTATTAAGCCCAAATCGTATTTTGTGTAGATAAAGTAGATCTTATGGCATGAGGTGCAAAAATCATA
TTTTTCAGTCTTAAAAAGTTCACTAATGATGTTTAATTAATGAGATCTTGATCTGAAACGTTTTTATGAAGGTTAAACTTATTTTCT
TCTGTTTAAGAACTTTTAAAATCATGTTGATTAAGATTTGGCATTTTTGGTAATGAGGTTTTAACTATTTAAACTTGTTATTTACTG
CCACACATTACTATTGAATTGTTAAAACTTGTTGGTTATAGGAAACCTCAAATTTTGAATGAGTTTCGGAGCTGACAGAAACCCAGG
CTGGGGTTCTGTCCGATCAGCGGTCGACCGCATCGAACTCAGCGGTCGACCGTCGCGAGTTTTTGCCAGCAGAATCGCTTCTGCACT
TTGAGCGGTCGACCGACATGACCACTGCGGTCGACCGCCGCTCAGCTTTTGAGCCCAGTTTTTCTCGGACCTGCGAGCGGTCGACCG
GGGCGGGCTCTGCGGTCGACCGCCGCACAGATTATTTTGTCCTGTTTATTTTTGTTGAACCTTACACTTGTTCGAGTGCTTGCCTTG
ATCATATAACTTTGGTTCTCAGTTTTATTAAGTATCTGTGCATGATAGATGGCTTGAAATGCCAGATTAGAATCACACACCGAGTTG
AGTGTGAAATTTGTATAAGTACATCTCCTCATACATCTCATTGACGATTACTATTTGGCCCATGTGGTGGAAAACTAGGTTAAATT
CAGTCCTCGTGTTGGACAAGCACCCCCCCTTAGTCCTCGTGTTGGACATACCTCTTAGTCCTCGTGTTGGATATGCATTACCACCCG
GTCCAGGCGTTGGACAACGGTCACATCCGATCCAGGCGTTGGACAACGGTCACATCCGGTCCAGGCGTTGGACAACGGTCACTTCCG
GGCCATGCGCTGGACAACGGTTATACTCAGTCCATGAGTTGGACGTTTATTTCATGTAGTCTATGTTCTGGACACTTAATCGTTTTC
TGACACGTCACCCATGTGAGTATGATATGACACTTATGTAGAATACGACATGGTATTCATGTAGGTCATTACCTAATACTGTATTTA

Fig. 13BF

TGTCTGAGATGGGTTGTATTTCTTTTTTTTTACTTGTTTTCTGTTCCCGTATTAGACTCTGGGTTTGGTACTTAGGGATTTTCAATT
TGAGATACAAGGTATATACATGAGGGTTTCCTTGTTTGGATTATTTCGCTCGACGTACCTATGCTCGTGTTGAAATTTCCTAAGTAC
TAAGACCCCCTTTGCTTCAGGGAATTTGTTTATACATATACATTTTGTGATAACTGTATTTTCTTATACAACGAGCCCTCTCCATTG
GGGTTGGTTGTGATGTTGCTCGCTAGCGCTTTGACGCTCATTGTCCCTCCCCCTTTCAGGTCACGAGCCAGGAGCCCGGAGAGTCGC
AGGTTGATGGCGACACACTTTAGTGTTCAGCTATCTTTTCTAGCTATGCTTTATGTTGGAGCTCCACTGTAGTATTTGTTAGACATT
TGAGGACTATGTTATAATTGTTGTAAAGGCTGTATCCCTTATTTCCTTTACTCAGACTTATTGTATTTGAGGCTTGTTGAAAACTCC
AGTTTGTTCATTTTAGACTTTGACTTTGTACTTCGGTATGTTGGATGATAAAATGTTATTATGATCTCTACCATTTCATCAGCTATT
CTCTGTATTATCTTTTACTTGCTTTTGTATCAACACCTGTTATTGACTCTACTAGAGTGATAGAATTGTGATGGTGAAACATGTTAA
TGTACGGTGTGGTGCATGGCAGGTTTGACATTCTTGGTTCACCGAGGACTGCAGCCTTGTGTGAACCAAGGGGCGTCACACAAACA
TCATGATCCCTTAGGATCATCCTGTGTCGAGTCGTAGAGCTAGGATAGAGTTTCTTAGGATTCATGTATAGAGTCCGATAAGAATTT
CCTAGTATGAGTGAGGACGATATATGCGTATATCTCAAAATTTTGAGAATTTTTTTTTATGACACCTATTTTTGTTTAAACTATTGG
TGTGAATATGAATATAATATGTTGTGAAAGTCGTATGGTGATACATTAGGTATGTACATATATCTATTTTGGCTCATGAACTCTTTT
TGTTATATGCTCAGATGTCGGAATATGGTATCCCACGTACCCCGGAGACCTGGACGGGCTGAACCACAACAAACTTCACCCGAACCAC
ATCAGACGCTACCTGAGCCGCAGCAGGCTCCCCAGTATCTGATAGATCTTATGGCTCCCTTAGTTGCTAGGGTAGCAGCAATCGAGG
AGCTTGTGGCCGAATCATATTACACCACCACCATCAGTAGCTGAAACCGCCCATTTTTCAAGAAAACGGGACGGCTAAGTTTCAGGAGG
ATAAGGAAGGAAGTGCTAAGAGAGGGCATACTGGAGACAAGGGTAAGAACAAGAGACCCTTGTCTAGACCTCTACAGCAGCAGCAGG
GCCCTCATAAAAAGGGATCCCAACAGGATCAGAGAGCACAACATCAGCCCAAGTTCAGGGGAACTTGTTTTAACTGTCGCAAGGTCG
GACACAAGGCATTAGAGTGCCGCAGTGCACCAACAAGAGCTCAGAAGAGAAATGGTCCGAATCAGCAGCAGCAGAAGATTGAGGGGT
GTGTTCTAGCAGTTCAGGAGGTTCCCCAGGGGCAGATCGTCCCATATTCTCCAACACCAGCAGCAGAGCTGTTTTTATTCACCGGCA
AAGTATATGCAGTAGTTCCGCATGATAATGGAGCAAACAAATCAGTTATGGAGGGTACGTCCCTCATAAATCCTTTTCCCCGCTCGT
ATTCTTTTCGATTCGGGAGCTTCGTGTTCTTTCATTTCGTATGCTTTTATGACTAGACTCCAAATCGTAGCTCAGCCCCTAGACATT
CCATTATCGGTTTTCCATCCCTTTAGGTGGGGTATCGCTTCTGGAGAGCATTTGTAGGATGTGTATTATTAGTCTAGGTGAGTCGGA
GTTTGTTATAGATTTGATAGTGTTGCATGTGTCCGAGTTTAATGTTATCCTTGTTATGGATTGGTTGTTATCCTGCCATATTAATTC
TGACTATCTTCACGAAGATAGCCAGATTGTGAGCATCCAATGGGTCCGAGATGATTGTGGCCACTTCTCAGGGCAATCGCTTTGCGG
AGTCTCTCCTGGCAATCATCGATGAGGAGATGTGACGGGATCAGAGTTCTGATTTGTTGGAGACTAGAGTTGTCTCAGATTATCAGG
ATGTCTTTCAGGATATACCTGGGTTACCTCCTGTGTGAGAGGTTGAGATTTACATTGAGTTGCAGCCGAGCACCGCCCCGATATCCC
GCGCACCCTATCGCATGACACTAGCTGAGATGAGAGAGCTTCAGACCCAGTTGCACGAGTTGTTAGCTTAGAGTTTTATTTGTTGGA
GTCTTTCTCCGTGGAGAGCACCGGCCCTCTTCGTGAAGAAGAAGGACGGCAGTATAAGATGGTGTATAGATTATCGGTATTGAACAA
GATCACTATCCTGAATAGGTAATCATTACCTAGGATTGATGACTTGTTCGACTAGTTGCAGAGAGCGCAGTATTTTTCGAAGATTGA
TCTTCGTTCTGGCTATCATCAGCTGTGGGTTTGGGAGATGGATGTTCCCAAGACCGCATTTCTTACTCGATATGGGTCCTTCGAGTT
CTTGGTCATGCCATTTGGGTTGACCAATGCACCCGCGGCATTCATGGATTTGATGAACCGGGTTTTTCATCCTTTTTAGATCAGTTT
GTGATCATTTTCATTGATGATATTCTTCTCTACTCGAGATCAGAGGCAGAGCATGAGGGGCATCTACGGGTAGCTTTGAGGACTCTT
CAGGAGCATCAGTTATATGCCAAGTTCAGTAAGTGTGAATTTTGGCTTTCAGAAGTCAGATTCCTCGGCCACGTCATCAGTAGAGAG
GGCATAGCTGTTGATCCAGCTAAGATTTCAGCAGTTCTTGATTGGGAGCCGCCGAAGACGGTGACCGAGATTCGTTGCTTTTTTTTG
GGTCTAGCGGGCTACTACAGGAAGTTCGTCCAGGACTTCTCAGAGATTTCGGCGCCGATTACACGCCTTACGAAGAAGGGTGTACAG
TTCATTTGGAGTGAGGAGTGTCAGAAGGCCTTTGATACATTGAAGGCTAAGTTGACTACATCACCGGTTTTGACTATTCCGATCAGC
GACAGGACATTCGTCGTATATACAGATGCATCGTTGGCAGGTTTAGGGGCGTGTTGATGCAGACTCAGAGAGTGGTAGCTTATATC
TCACGGAAGTTGAGGTGCATGAGCAGAACTATCCCACTCATGATTTGGAGTTGGCAGCGGTGGTGTTTGCACTGAAGTCATGGAGG
CACTACTTATATGGAGTGCAGTTTGAGTTATTCACAGACCATCAGAGTCTGAAGTACTTTTTTTTTCTCAGAAGGAACTCAATCAGA
GACAGAACAGATGGATTGAGTTTATTAAGGACTACGAGTTCGCGATTCAGTATCATCCGGGGAAGGCGAACGTCGTAGCAGATGCTT
TGAGTAGGAAGCGTCGACATCAGGTTGCGGCTTTGAGGTGTTCATTGTACAGAGATCTCCTTACTCTTAGCCAGTTTGATTTTAGAC
CCGAGATTTGGAGGAACCAGTGCATTTTTGGGAGCTATATCAGTGCAGCCATCTTGGAGTGACTGAGTTGTCAGAGCTCAGTTGGGA
GATTCTTGGATCCAAATCCGAAAGGAGGAGATTTCCAAGGAGCCTAAGGCTGATTGGACCATTGGAGCAGATAGAGGTCTACGGATG
AAGAGTAGATTGGTTATGCCAGCCAGTGCAGAGCTGAAGAGGGAGTTACTTGATGAGGCACACCGTACTCGATACACAGTGCATCCA
GGGACCACCAAGATGTACAAGGACTTGAAGAGACATTTTTGGTGGACCGGTATGCGTAGAGAGATAGCAGACTATGTGGCTAGATGT
TTTACCTGTCAGCAGGTGAAGGCAGAGCATCAGAGACCAGCAGGGACACTTCAGCCTTTGCCTATTCCGGAGTGGAAGTGGGCGGAT
ATTTCTGTGGATTTTATTGTGGGGTTACCGAAGTCGAAGAAGGGGAATGATTCTGTTTCGGTGATAGTGGAGCGGTTGACGAAGTCA
GCACATTTTATTCCAGTGAGGACCACTTATACAGCTGAGGCTTATGCGAGGATCTTCATTCGGGAGATAGTTCGGCTTCACGGAGTT
CCGAACACGATCGTGTCGGATCGAGGATCGGTTTTTTTTACTTCACATTTTTGGAGGAGTTTCCAGGACTCATTTGGCAGCAGGTTA
TCTTATAGCAGTGTATTCCACCCCAGACGGATGGTCAGACGGAGAGGGTGAATCATGTATTGGAGGACATGTTGCGGGCATGTGTCA
TTGACTTCCAAGGCAGCTGGGAGGATCACATTCCATTGGTAGAATTCGCTTATAACAACAGTTATCAGGCGACTGTCGGTATGGCTC
CGTATGAGGCATTGTACGGGAGGCTCTGTAGATCACCGATATGCTGGGCAGAGCCGTAGGATAGTTTGATGCTTGGGCCAGAGCTTG
TGAGACAGACTACTGAGAAGGTAGCATTGATCAGAGAGCAGATTCTAGCCGCTCAAAGTCAGCAGAAGAGCTATGCAGATAAGAGGC
GAAGACCACTAGAGTTTCAGATTGATGATTTGGTTATGCTGAAGGTATCGCCTATGAAGGGCGTGCAGCGATTCGGGAGGCAAGGGA
AGCTTGCACCGAGATATATTGAACCTTTCCGGATTTTAGAGCGCATTGGAGCTGTGTCATACAGACTAGATCTTCCAACATCCATGT
CTAGTATACACAATGTATTCCATATCTCTATGCTCAAGAAGCACTTGCACGATGAGGAGCAGCAGCGAGTGTTGGATGCACCGGAGG
TTGAGCTTCGGGATGATTTGACTACTATTGAGATCCCGGTGTCTATACTTGCTAGAGAAGATAAGAGACTCAGGAACAAGGTGATCC
CATTGGTGAAAGTTCAATGGAACCGAAGTGGATGTGAGGAAGCTTCTCGGGAGCGCGAGGAGGACATGCGGCGTGACTACCCACACT
TATTTGAGCAGGTAAATAAATTTCTTATGTCATAAACCTTATGTTATGTTTATATCTTTGGTTATGTTTATATTTAACACTAGAATG
AGAATATCTTTGCTTAATTCTTAATCTTTTGGAACACATGGTATATATATGGGGGGTTCCTTGTTTGGATTTTTCACCCGATGTACT

Fig. 13BG

AGTTCCATTAGATTAGGGCTTGAGCGAGAATATTATCATTTTGGACGGTTAAGTATAAAATATCCATGTGCGCTCATCTAGAATTTCA
TATTTCGAGATGAGTATGATTTCCGAATTTCGAGGACGAAATTCTTTTAAGGGGGGAAGAATGTAGAACCCCGTAAATTTATTAATG
AATATATTGAGTTATTAGTGGTAAACATTTCTTTTGAGATGAATAACCATATATATATTAAATGTGATAAATAGTGTTTGGGAGCCT
AGCAAGAATTTCTATGTTAGAGAAATCAAGGGGATTGATCAGCATGTGATAGAAGGCATAGCAGGCAGTTGTTCTGCTGTGCGGTCG
ACCGCGATGTGCGCGGCGGTCGACCGCACAGCAGTCGGGCACACAGGAGACTTTTCTCCTGCTGTACGGTCGACCGCGTAAGGAGCG
GCGGTCGACCGCACAGCAGGCAGAGAGTTTTTCTGTGTTGGCTCTTAATGGGTTTCGGGTCGGGTTCGGGTCGGGTTGTGGCGTTAC
TATATATACTATCATACCCTAAAGAGCCCCATTTTCTCATCTGAATCAGAACCCTAGCCCCCTCTCTCCCCCTCAAACCCTAGTTCG
CACTTCTTGGTGATTTGGGAGAAGCCTTGAAGGGATTTCCAGCGAACTCTTGGTGGATTCAGCGTGGGGGGCCATCTTCCTTCAGAT
CTAGGGCGTTGTTTTCATCAGAGGCCAGTAACATCTCGCCCAACTTCATCCCATTTCGTTTTTATGCTTAGATTTGAGTTTTTATCC
GGTTTTATTGAGCCCAAAATCGTATTTTTGTAGATAAAGTAGGCCTTATGGCATGAGGTGCAAGAATCATATTTTTCAGTCTTAAAA
GGTTCACTAATGATGTTTAATAAATGAGATTTTGAACTGAAATGCTTTTAGAAGAGTTAAACTCATTTTTACTGTTTCCCAGCAGAA
TCGCTTCTGCACTTTGAGCGGTCGACCGGCATGACCCCAGCGGTCGACCGCCGCCCAGCTTTTGAGCCCAGTACTTCTCGGACCTGC
GAGCGGTCGATCGGAGTAGGCTATGCGATCGACCTCCGCACAGATTATTATGCCCTGTTTGTTTTTGTTGAACTTTCCACTCGTTCG
AGTGTTTGTCTCGACTTTCTAACTTTGGTTCTCAGTCTACTAAGTATCTATGCATGATAGATGGCTTAAAATGCCAGTTTAGAATCA
CACACCGAGTTGAGTGTGAAATTTGTATAAGTACATCTCCTCATACATCTCATCGACGATTACTATTTGGCCCATGTGGTGGGAAAA
ACTAGGTTAAACTCAGTCCTCGTGTTGGACAAGCACTACCCCTTTTGTCCTCGTGTTGGACATACCTCTTAGTCCTCGTGTTGGATA
TGCATTACCACCCGGTCCAGGCGTTGGACAACGGTCACATCCGGTCCAGGCGTTGGACAACGGTCACATCCGGTCCAGGCGTTGGAC
AACGGTCACATCCGGTCCAGGCGTTGGACAACGGTCACATCCGGTCCAGGCGTTGGACAACGGTCACATCCGGTCCAGGCGTTGGAC
AACGGTCACATCCGGTCCAGGCGTTGGACAACGGTCACTTCCGGTCCATGCGCTGGACAACGGTTATACTCAGTCCATGAGTTGGAC
GTTTATTTCATGTAGTCTATGTTCTGGACACTTAATCGTTTTCTGACACGTCACCCATGTGAGTATGATATGACACTTATGTAGAAT
ACGACAAGGTATTCATGTAGGTCATTACCTAATACTGTATTTATGTCTGAGATGGGTTGTATTTCTTTTTTTTTACTTGTTTTCTGTT
CCCGTATTAGACTCTGGCTTTGGTACTTAGGGATTTTCAATTTGAGATACAAGGTATATACATGAGGGTTTCCTTGTTTGGATTATT
TCGCTCGACGTACCTATGCTCGTGTTGAAATTTCCTAAGTACTAAGACCCCCTTTGCTTCAGGGAATTTGCTTATACATATACATTT
TGTGATAACTGTATTTTCTTATACAATGAGCCCTCTCCCTTGGGTTGGTTGTGATGTTGCTCGCTAGCGCTTTGATGCTCGTTGTC
CCTCCCCCTTTCAGGTCACGAGCCAGGAGCCCGGAGAGTCGCAGGTTGATGGCGACACACTTTAGTGTTCAGCTATCTTTTCTAGCT
ATGCTTTATGTTGGAGCTCCACTGTAGTATTTGTTAGACATTTGAGGACTATGTTATAATTGTTGTAAAGGCTGTATGCCTTATTTC
CTTTACTCAGACTTATTGTATTTGAGGCTTGTTGAAAACTCCAGTTTGTTCATTTCAGACTTTGACTTTGTACTTCGGTATGTTGGA
TGATGAAATGTTATTATGATCTCTACCATTTCATCAGCTATTCTCTCTATTATCTTTTACTTGCTTTTGTATCAACACCTGTTATTC
ACTCTACTAGAGTGATAGAATTATGATGGTGAAACATATTAATGTACGGTGTGGTGCATGGCAGGTTTGACATTCTTGGTTTCACCG
AGGACTGCAGCCTTGTGTGAACCCAGGGGGTCACAGTATGACCCTCGTCAAAATAGCCAACAATGTTGGACATGTGAAGTGCAACT
TGCGAATAAGGCTCATCGAAAGATGAAACAAGTCATAGAGACGAGAATCATCGATGACGAGCCTCATCCAGTCAAAAAGACGTCATC
TTTATGATGAGTCTGGAAGAAACTGTTCATCTTCCTCAAGAAACCCAAGTCTCAAATAGACAGGGTTGACATCCCTTAGAACGCAAA
TTATGCGTTTAAGATCTATTACCTGAAAAGCTGGGTAGAACGCCAGGTTCGTGCGAAGAGCTAGCAACCTTCTTGCCCTGACTCTTG
CTTCGGTTTACAGCGGTCTTAGGGGCCATTGATTTCGCTTGAAGAGCTTGCGAAAAAAAGAAAGATCAGAATTTTGAGAAGAGAAGG
AGTTCAGATAACCCAAACGACGAAGAGAGAAGAAAGGACTTCTCATATTATGATACCCTATTTATAGGAACGGAAAAGAGTCGAAT
CAAGGCCGCGATCTTCAGTTAGGGTCGTTTGACGAGATCTCTCCCCAACAAGATCTACGGACGGGATTCAAGGGGATTTCCTATCA
CCAGCTAGCAACCATTCGCTAGGTCTGGGAAAGGTGCATAGCAGTGATGCTGACGAAACTACAATAGGTCATTTGTCAGACGGGACA
GACTCCAGAACGAACAACAAAATAACTTTCGCGAACACGAGGTTCACGATAAAACCAGGTTCGTGAAATAAACTCCTCAGGTTCGAG
ATACCTATTCAAAGTATTTCAGACTACATACAACCCGATTCAAGTCTGAAAACTTTGAAGGGGGTTTTGTAGACATTAAAAAATGCC
AAAATTCGAAACGTGAAAAGAGAGGTCAGGGAAACGAACCCCTTTTCAATCAGAAACGAGGTTCGTTGTTTAGAAAAGATCAACCTC
AAGAACAAGAGTCACCATGCAGCAGAACTCAACATCGAAAGATAAAGTTCATTATTGAATGAAACGGATCTACGAGACTCGGAGCTC
GTCATTGGACGAGAGTACGTTGAAGCTCGTCATTGGATACGAGGTTCGAAGTTCACTAGTGGATACGGGGTTCGAAGCTCGTCATTG
GACACGAGTTAGACTCTAGTTGTCAGAGATGAATCTCATCATTGGATGCGAGGTTTGGAGTTCATTATTAAAGATGAAGTTCGTCAG
TGAAGACGAAGCTTACGAGGCTCGCCAAGCAGCGAGTCTCGCCATCAAAGATGAGGTTTGCCAACGCAGTGAAGTTCGTCACCCGCA
TTAAATCAGGCTGTAACGGTCATGAAGACCCAGTCAGCCACGTGGACTAAATTCAAAGAGTCAGTTACGCCCACGACTTCGCAATTTT
AGCGTATCAGTTACGCCCACGACTCCACTATTGTAGCACGTCGGTTACGTGCTCAAACTCCTATAAATAGCCATCGATGGCTACAGA
GAAAGGGTTGGTTGATTACTCTGAATTGGAGAATTTTAAGCTTGGACTTAGAGATGCATCAGAGTTTAAAGTTTCTACATGTCAAT
CCGGAGTTCGAACCTCGATTCCAGTTGGTTAACCTACGTCAGAAGCTCTTGCGATCTTGGTCTGATCGTCAACAGGAGGCAACGTTG
ACTCAAGCATCAGGGGAAGCATCCTTTCGCCACCTGATAATCACATTTTATTACAATTTTATACCCTCATTATCGATTTTATATGAA
TAAATATACCACTAATAATTGCTTTTATCTTTAATTGCAGGTTAATGAAGAATAAGAGCCCAAACTCTCATCTCTCAATAAAAAGCC
CTCGATTTAATAAAGAAATGAAGCCCATGAAGCCAAAGGAATTCTTTCAAATATTTAATGAAGAAATAATTCAAAGCCCAATGGAAA
ATCAAGAGAAAATGCCAAGCCCAAAAGTCCAAGCCAAAGCCCAAGATACAAGCCCAAAAGCCAAATACAAGAGTTCTGAGGACAGCA
ACCAGAAGAAGGTAGGCATCGATGCCTGCATCGATGGGGGCATCGATGCCTATATCGATGCCAGCATCGATGCCTGTATCGATGCCT
GCATCGATGCCATCGTACAGTTTGTTATAGATCTAAGGCTGAAATTTGTTATTTTTGGATAAGATTTCAATCCAATAGCTCTCATTC
AGTCATGTTTACTATAAATAGGGATAGAGAGTGAGGGGTTAAGGGTGTGAAAAATTTTGTAACTCTATTTGGAGAGGAGGGCTACTC
TTAATTGAGAAGGCCTTCCAAAAATTGTAACTTTTATTGTAATTAATAAAAATAATTTTTTCCTCTTTAAATTTGTTCTTTCTCCTC
TTGTTGAATGATGAGGATGGAGATGAAGAGCAAATTGAAGGTTTGCATTTCTTTTCTCTTTTATTTCTTTTTAGTAATTTCTTTATT
ATTGCTTATTAGTTAGATTTAAATTCAATAATAATAATTTTTCTCCTCTTTAAATTTTCTTTTCTCCTCTTTGTTGAATGATGAGGA
TGGAGATGAAGAGAAATTTGAAGGTTTGTATTTCTTTTATTTTTCTTTTTTTTATTTCTTTTTAGTGATTTCTTTATTATTGCTTATT
AGTTAGATTTACATTTATGCTTGTAGTGTAGATTTATTTTCTTGTCTTTTTATTTCTTTTTGTACTTTATTTTGTAGAGTAGATTTA

Fig. 13BH

TTTTCTTGCATTTAATTTCTACAATTTATTTTGTAGTTTAGATTTTTATTCTTTGCAGTTAGATTTATTTCTTGTTCATAGTTTAGA
TTTTTCTTTTCTTTTTATTTTTGTAATTACTTCTTTTTTCTTGTTTTTTTTATTTCTTAACATGTGAAATTAATTCTTGTAGCAATC
TTAGAATTACATAAAACTAGTCTAATTTCCTTTATATTGTATGAATTATTCTCTTGCACTTAAAATGTTCATGTTTAGGATAATCAA
CTAGAGAACTAATCGGTAGAAGAAGAATTTGATAATCTATGCTTATCTTAAATGCTTTGATAGGTTATGCTTATGAATTCTAGGATT
ATTATCATGTTGTTGTTCTTATCATGAATAGTAATTTTAACTATACTTTTCTTAAATGGTTTGATAGTCTATGCTTAATAAATCTAA
GTTGAATTATGATAAAAATAGAAAAGTTTGTATTTTGTAATTAAAATTAGCTAGTGAATTATATTCTAGATTTCTTACCTCTTGTGA
ATCCTCCATCTTGACTTTATTTAATTTTTCTTTTTATTCTTGAATTTATTTCTTGATTTTATTCTTTCTTCTTTCTTGCCTTGTGAT
TTTTTAATTTTTCTTTTTATTCTTGAATTTATTTCTTGATTTTATTCTTTCTTCTTTCTTGCCTTGTGATTTCATTCATTCTTTGAT
TCTTATTTCTTTTCTCTAAAATTCAATTTATTGTTATTTGCACATAAATCAAAACAACCACTCATCATATCTCTCATCACAATCACA
CTTATTCTTTAATCCTATCTTGTCACACACAAAACAGAAGAACCAATTCTAATAATCTCTTAAAATCACCTTCCTCGTGGGATCGAT
AACTTTTTATACTATAACTTGATCAATTGTGCACTTGCAATTTTGGTACATAATTATGCCGTATCAAGTTTTTGGTGCCGTTGCCGG
GGACGGTGCTTAAATAGGATTTTATTATTTTGGTTCTTTAACTTGTGTGTTTTCTTGTGAAGGAACCGCTTGGAGCTTGAAAGTCTT
GGATTGAAGATCAAGAATTTAGAGAATTGCTTTCGGGTAAGTCCTCTTTTTAGTTTTCAATTCTACCCTTTTTAGTTAGCTTCACAA
TTAGAGACACTTAGGATTTAAAAAAAAAACAAAAAGATTTTATTTTTGTTGACCATAATAAAACCCACCTTTCACTTGGACATTAAC
TAACAAGATAATAAATTCAAACAAGAGACCTCTTCTCATATTTGATTGTTGTTGACCATAATTAAAAAAAAAAGATTTTCTTTTTATC
ATCATTTTTAGTCGCTTTTAATTTCTAGGGTTGCATTTCATATAGTATAGGAATTCACCAAAGTGATTGTAGCACTTAATTTGGCAC
ACACTTAAAACATTCTTAAGGGCAAAACCCATAATCAAGATAAGGTAAGGGATTTCATCACCCTTTCCTTAGCCCACAAATCACTAA
TTCCTCACTTCACAACCCAAGCCTTCTAAAACTCATTAGACGTTGGCCCCTAAGGATTCGAGCTCAATAAGGAACAAGAAATCCTTA
AGTGAACCAGTTTAAGTTTTCTCAGATTAGTTGGTGTCTAAGGCAAGGTTTAGGGGTTTCGTAAAGCGCTCCGCAAGGAATGAGGTA
CTTAATTGATCTCTGATCAACCTCTAGTACTATCCTTACCTGGCTAACTACCTGGGTAAAACTTTAATCTTTTCACTGTAGGAGTTT
TTGGTTAGGAGCTGGTCTAGTTGAGTTAGGCTAAACCCTAGAATTAGAGTGTGATTGAAAAGTGATTGATTTGATTTGTTTTAGTTA
GGATTTTTCTTCTCATAAAAAAAAAACTAAGTTTCTTTCTCTCCTTAAAAGAAAAGAAAAAACTAATTTTCTTCCTTCCAAAAAAAAA
ATGTTTTGGTGTATGCAAACTTGGGTTCGGGATAATTCTCATCGTTTAATCCGTATTGAACCAATCCAAGAAATGGCAAATCAACCT
GTTCTTCAGGCTATGTGTTACCCCACTAGAAATGCAATTCCATCTTGCATAAGACTCCCCGAAGTAAATGGAGTAAATTTCGAGCTT
AGACCGCATTACATAAACATGCTTCCCAAATTCCTTGGTAATGAAACAGAAGATGCATATATATTTATATCGGAATTTGAGGAAGTA
TGTATTATGATTAAAATGAGAGAATTAACTGAAGATGCGATTAACCTTAGATTTATTCCATTTGCTCTTAAGGACAAACCTAAAAAA
TAGCTGTACAGCTTACCGATAAATTCTATCTCAACTTGGGAGGAATTTGTCACCGTTTTCTTAAAAAAATTTTCCCTATTCATAAA
ACGGTAAAGCTTAGGAACAGTATTCAAAACTTCAAAATTGTCCCACTGGAGCCATTCTGGAAATATTTTGACCGATTTAAAGATCTT
TTAATCCAATGTCCTCATCACGGTCTAGAAAAATGGTGACTGTGCCAAGTCATATATGAAGGATTGGACTATTCTTCAAAAACATCT
TTAGAATCGATGTGTCAGGGAGATTTTATGAGGAAAAACGCCGATGAAGCTTGGGAATTCCTAGAGAGTCTATCCGAGAAAACAATG
CAGTGGAAAAACTATGATGATAGGGTTTTATCTGTTTCCCAATCTAAGTCTAGTGGTCTTTCCCTGGAGTCAAACATTGCTTCTGAA
GCAAAGATGGCGACAATTCTGCGGAGGTTAGAAGCCTTAGAAGTTAAGGAGCGAGCTCCAGCTCAAATCAATCATATTTTTGCCCCG
GGATGTCATAACTGTCAGTCTTCTACCCATGTTTCAGAGGAATGCCCTCTCCTAGGAAACAACCATGCTTTAGAACAAATGAACGCT
GCATTCCAGCACCCTAGAAATGATCCATTTTCTCCAACCTACAATCCAGGTTGGAGAAATCATCCCAATTTTGCTTGGAACCAAGGA
AATTCTCATGGAAACCAAAACTTCATTCCCGCGTCGAACCAACAATTCCCTAGGGGAAACACTGTCCCATTCAACGCACCAAACAAT
TTTCAAAAAGCTAACCCTATTTTTCCAAACCAACATCCTCATCCTCACCAGCCTACAAATCCTTCAAATTCTGATCATGACAAACAT
TTGAGTGTCTTAGAAAAGGGTTTAGAAGTTATGATCAAAGCTTCTACACAAACGACCAACATGTTGACCCATTCATCCACCACTCTA
AATTCTTTCATGCAAACAACCGGCCAAGTGCTAAACTCAAACACTCAAGCCATAGCTCGGTTAGAAACCCAACTTGGGCAACTAGCC
ACTACCGTAAGTAGAGAGAGAAAAAGGAAAATTCCTAAGTCAACCTGTTACAAACCCTAAAGACACTGGATCCAGTTCCAACAATCCA
GCTTAATTGAATGTAGTTCACACACTGCGATCAGGAAAACAAATAGACAACCAAGTTAGAATGCCACCGGATCAAACCCCTTCTCCC
ATCCAACAAACTCCTTCTGATGAAGCAATTCCTTCCGATGACCAAAGCGCTGAACTTGAGATTGAACCTGATCTAGATAGGTATAGG
CCCGTTGCCCCCTTTCCAGATAGACTCAAACCTAGAAAAAACTCCCCGCAGGTTGAGAAAATCCTAGAAACATTTAAACATGTCAAG
ATCAACATCCCTCTCCTAGATGCAATCAAACAAATCCCTTCTTATGCAAAGTTCTTGAAGGACTTATGCACTAAGAAAAGAATCACC
AACGTCCCCAAGAAAGTCTTCTTAGCTGCCAACCTTAGTGAAATTTTTTCAAAACCCATGCCGTTGAAATACAAGGACCCTGGTTGT
CCCACAATTCCATGCGTCATAGATAACACTCACATTGATAAGGCACTTCTAGACTTGGAAGCCAGCGTCAACCTCCTTCCTTATTCG
GTCTATCAACAGCTAGGTGTAGGATAACTTAAACCGATGCATGCCCTTTGGACTGTGTAACGTACCGGCCACATTCCAACGTTGCAT
GATCAGTATTTTTTTCGACATGGTAGAGCGATTTCTCAAAATTTTCGTGGATGACTTTTCCATCTTTGGTGACACATTTTCCCAATG
TTTGCATCATCTTAAATTGGTCTTAGAACGGTGTAGGGAGAAAAATCTGACTCTCAATTGGGAGAAATGTCATTTCATGGTCAAACA
AGGCATTGTCTTAGGACATGTAGTTTCCAATAGGGGAATTGAAGTGGACAAAGCTAAGGTAGATCTCATTTCTAATCTCCCTCCTCC
CAAAACTGTCAAAGATGTCAGATCGTTTCTTGGTCATGCTGGTTTTTACCGACGTTTCATCAAGGATTTTAGCAAAATTGCTAGACC
CTTGACCAATCTCTTAGCTAAGGATACATCGATCATTTGTCTTCTCCCCCGACTGCCTCAAAGCTTTCGAATATCTGAAAAAGGAGC
TAACCACAGCTCCTATCATTCATGCACCAGACTAGATCTTACCCTTCGAACTGATGTGTGATGCATCTGATTTTGCGATTGGAGCTG
TTTTAGGACAACAGTTTAACGAAAAACCGCATGTGATCTACTACGCCAGTAGGAATCTGAATGATGCCCAACAAAATTATTCTGTCA
CAGAAAAAGAGTTTTTAGCTGTAGTCTTTGCCTTAGAAAAATTCAGGTCCTACCTCATCGGTTTCTTAACCAAAGTTTTCACAGATC
ATGCCGCAGTAAAGTATATTTTGACCAAAAAGAATGCTAAAGCACGGCTCATTAGATGGATTCTCCTTCTTCAAGAGTTTGACATCC
AAATTCTTGACAGAAGGGAAACAGAGAACCCCGTAGCAGATCACCTTTCTCGACTACAGAACGCACCAACATTAACCGTTCTGATCA
ATGAGCATTTCCCTGATGAACAACTCCTACAAATCCAATCTGTTCCATGGTTCACTGACATTGTGAATTACATAGTCATGAACCAGA
TCCCTTCTCATTGGTCCAAACAGGATAGATCATGTTTTCTCTCCTAAGTAAAATACTTTTACTGGGATGATCCATATCTGTTCAAAT
ACTGTTCTGATCATATCTTTAGGAGGTGTGTTCCCACTGAAGAAACTAGGAGTGTTCTATCATTTTGCCATGAGCAAGCATGTGGGC
GCCACTTTGGCCCGAGAAAAACAGCTAAAAAAGTTCTTCAATCTGGGCTGTATTGGCCTACTCTCTTCAAGGATTCATTCGAGTTT

Fig. 13BI

GCAAAACTCTAACCGCTGTCAGCTTTTAGGGAAGGTCACTAGAAGAAATATGATGCCCTTACAACCCATCTTATCTGTTGAACTTTT
TGATCTGTGGGGTATCGATTTCATGGACCATTTCCAAATTCCTTTGGAAATGTTTACTTTCTACTAGCCCTTGAATACATGTCAAA
ATGGGTTGAGGCGGTAGCTTGCAAAACTAATAAAAACAAGGTCGTTGTCAAGTTTTTGAAAGAGAACATTTTTGCACGGTTTGGAGT
ACCCCGAGCGATCATCAGTGATAACGGTACACATTTCTGTAACCGTTCTTTCGAAGCTTTGATGAGAAAATATTCAATCACACACAA
ATTGTCAACTCCTTATCACCCCCAAAGCACTGGACAAGTTGATGCGGGACGATGGGACTTTTAGGGTTTTATGTAAGGGATTTGGCA
AATTTGGGGAAGAACAAAGATTTGGGGAAAACTAGGGTTTGAAAGATTAACAAGATATGACCACGAATCGCAACCCGGGCCTTGGCT
TCACCACCATTGACTCAATCTTAGAGATCAAATCAATTACCCAAAGTTTCACAAATGAAACAAAATTTTCTTCAAATATTCATTGAT
ATATGTGCGAAGTGGAGGCTGTGCGATGTCCTCATCAATTCCCCCGGGGTGGGAAGAACTCGACCCCGTCGAGTTAGGCTCCAACTG
GCCCTCATAATACTCCAATAGATCCGGAGCCAGGCGCTGCAGGTCCTCACGAGTAATCCATGTATCATCAGATTCAGGACGATCTTT
CCAACGTACTAGATATCGTCTGCAACCACCATCTCTGGTGGAGATGATTTGGTCATCTCGAATGCTATCAATCTGTTCAGCTGTAAA
TGGGACAAAAGTAGTAGGCCAGTGGTGGCAATGGGGGTCCCTCAAGGAAAGGATCAGGGGTAGGCTCATCAAGATCCACAAGTGGCTT
TTCAGGGTGAAAAGGATGACCTTTATAAGCTACCAAATCTGCAATATTAAATGTCGAACTAATTCCAAAATCTGGAGGTAAATCGAT
TACATAAGCATTTGAGTTAATTTTCTTGATAATCTTAAAAGGTCCAGCACTACGAGCATGTAATTTCTTGACGGCTCCAGGAGGAAA
CCGTTCTGGGCGAATTCGGATCATTACATAATCACCTTCGTTAAACTCAAGATGTCTTCTATGTAAATCAGCATGAGATTTATATTG
TTCATTGCTTTCTTGAATTTTCTTGTTGATTTCTTGATGCAAATCATGAATGTGTGATGCAAATGCAACTGCTGACTCGGACACCCT
AGGATGATGCGACATGGGAATAAGGTCTATAGGCTTCCTAGGCTTGTAACCATGCACAACTTCAAATGGACTCATGCCTACAGACCT
ATTGACTGAGCTATTGTATGCAAACTCTGCAGTGGATAACAGAAGATCCCAATTTCTTAAATTCTCACCAACCAAACAGCCCAAAAG
ATTGCCTAGACTCCTATTAACTACCTGAGTTTGACCATCAGTTTGGGGATGAAAAGCAGACGAATACTGAAGTTTAGTTCCCATCTT
GTCCCATAGAGTTTTCCAAAAATAACTCATAAACTTTACATCCCTGTCTGATACAATGGTTTTGGGCAAACCATGCAATTTGACCAC
ACCATCAAAGTAGATCCGAGCAATTTTGGATGCATCAGACGTTTTGTTGCATGGCAAGAAGTGGGCCATCTTTGAAAAGCGATCCAC
AACTACAAAAATGGAGTCATGTTTTCTGATAGTTTTAGGAAGTCCCAACACGAAATCCATACTTACATCCTGCCAAGGACGATCTGG
AACAGGGAGAGGTGTGTATAGGCCAGTATTTTGTTTACGTTGCTTCGCTAATTGGCAAGTGCGACATTGTCCTATTAACTTTGCAAC
ATCTCTTTTAAGGCTTGGCCAGTAAAACAAAGTTTCTACCGCCTCTATAGTCTTTTCATGACCAAAATGACCAGCAAGCCTCCTGC
ATGCAATTCCCAAACAAGATAATCTCTTAAAGAAGTACGCGGAATGCATAACTTGCGAAATCGAAATAAATAGCCATCTTGGAACAA
AAAGCCATCTATCTCGGAAGTCACTCCTTTTAAAGAAACAAAAATCTCTCCAAAGTCGGGGCATGATTCATACTCCCCTTTGATTCT
TTCGAAACCCAATACCTCTGCACTCATGCGGTTTAGAAGACAAGCTCGACGACTGAGTGCATCAGCCACCTTGTTCTCAACTCCAGC
CATGTGTTTGAGGGTATAAGTGTAGTCTTGTAGAAATTCAACCCATCGAGCACGCCTGGCATTGAGTTTCTTCTGAGAGTTAAGATA
CCGAAGGGCTTCATGGTCCGAATAAATAACAAATTCTTGTGGTAAAAGATAATTGCCCAATGGCCCAATGATTGTACAACCGCATA
GAACTCCTTATCGTAGGTAGAGTAGTTCAGTTTAGCACCCTAAGTTTTTCAATAAAGTAGGCAATGGAGTGCTTCTCCTGGCTCAAT
ACTCCACCCATACCAATACTGAGGCGTCACACGCGACCTCAAATACCTTAGAGAAATCAGGAAGTCTCATAACAGGTGCATCGGTCA
TTCGCTGCTTAATTTCTTTGAAAGCCGTGGCAGCTTCTTCGGACCAACGAAATTCCTCTTTTTTTAGGCAATCCGTAATTGGGGCCA
TGATAGCACTAAACTCCTTGATAAATCGCTTGTAGAAAGTTATGAGCCCATGAAAACTGCTTACATCTCGGATACTCCGAGGCTCGG
GCCACTCTACAATTGCCTGAACCTTTTGAGGGTCAACAGAAACTCCTTGAGAAGACACAACAAATCCCAAAAATATAACATGGTCAG
TCATGAAAACATATTTCTTGGGATTTGTAAATAGTTTCTCTTTCCTCAAAGTGAGACATGTTGGGATTTTAAGGAGATTAATCTGTG
GAATTAAACACTAAACGAATAACGACACCAATAAAAAATATCACAAGTAAGCAAACACCAAGATTTAACGTGGTTCGGTAAATCGTG
CCTACGTCCATGGGCAATTCAGAGAGAAATATTTCACTATGAATCGAGAGTACAATCCCTCCAAGTTACACCTAAACTTGAGGATT
AAATCATAAGAGAAAAATATAGTGTTACCTCTAGGGCACCAAAACCCTAAAACTTATCTCACCAAAAATNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNATATATATATATATATATATATATTTATACATAATTACTCATTTTGTTAAAAAAAAAGACAAAACAACAAAACAAAACAAAAC
AACAAAATTTGAATAAGTAACATAGGCCTAACAAAAAAAAAAAGAAAAATAAAAAGATAAAATAAGTGTTGCCCACAAATCAGCCC
CAAAAGAAAAAAAATTAAAGAAACCGTGTTTGGCCGGCTGGCCCAAACACCATGGTTCTGGGCATCGATGCCCGCATCGATGCTCC
ACCCAGCAGCTTTTAAAACCGCAGCCCCACCCCAAGCCACTTTCTTCTCCTCTTTCTTTCAACTCCCAAACCCGATTTTTTTCCCCC
TCAAACCCTAATCCCCCCACACAAGATCAAGATCACAAGGAGGAGATTTCTTCACTATTTTTGGCCTTCTTCCACCTCCACTCATC
TACCCAATGTATTGTTTCTAACTTGATCTTATAATTTTTATGAATACATGGATGATTTGGTGATTGAATCATAGGTAGTTGTGAATG
ATTATCATATTTTGTGTTGATTCATGATCAATTTAGTAAATTTAGGGTTTAATTTGGGGATTTGCCAAAATTTGGGGATTTTGTTCA
AAAAAAAAAAATCCGAAATATTGGGGGGATTTATGCAAAATTCGAAAATTTCTAGGGGGTTTGAACTTAGAACTCAATTGAGGATAT
CTTGTACAAAAATTTGAAAAAAAAAATATTTTGGGGTGTTTTGTGCAAAACCGAAAAAAATTTGGGGTGTTTCATGCAAACCCGAAAA
TTCTTAGGGTTTTTGTGCAAAAACAAATACTTTTTGAACATTCAATTGAGTACGTGATTTCAAAAAAAAAACTTGAATTTAGGGTGT
TATGTGCAAACAATTCCAAAAAAAAAATTAAGGTTTAGCTTATAATTGTAATATCAACATGTGGATTTCATCGATCAAGTTATCAAA
ATTTTAACATTGTTGTTCTAAAAGAACAATTTTGAGGAAATTTTTTGTCAAAACAAAATTCTGATAACTTGAAATTAACTCATTTTG

Fig. 13BJ

AACAATTTGTAGCTAAATTCTTGTCAAAAAATAAAAATAAAAATAATAATAAGTAAATAATAATATTGGAATTTTGTTATTAAATTT
TTTTCTTTTCTTTCTTTTTCTGTAGATGCCCCCAGAAAGAAATTTCGAGCAACTTCATCATCTTCTGATCCATCTGATACCGACATA
GATAGACCCACTATTTTAGCCAAAATTATGGGTCTTAACATTCATTTTGAGAGGGGATTTCAGATGAGTGCATTACATACATATCAT
TCCACAGTCACCATGTTAACTGCAGTAGGTCTTACGACCATGATGACTAAACCCTTAGAAAAAGCAAACATTTCATTAGTGCATGAG
TTCTATTCTGGATGGGAGATTGATCCAGATAGAGAATATTCAGCTTTTTCTATCGTGAGGGGTGTTAGGGTTATTTTCGATCTTTCC
ACTATCCGTGCTACCCTTGACCTTGCAGAACCACCCACTGATGTACCAGATTACTTCCATTTAGCCTCCACATTACAGCCTGGTACA
CTAGAATACAACAACATGTCTGCAACCTTGTGTGGAGGATCTTTACATCTAGTTTCGGTTCAGGAAATCTCAAACCAGAATATAGA
TTACTTAATCTTTTCCTGAACTTTGATTTGAAACCCACCACTACATACTCTGTCATTACCCCACACGATATTCTCCTTCTCTTTTGG
ATAGCCACTGGTTTGCGATTTGATATAGCCAGGATTATATTTGTATGTATGCGCTCATCAGTGGAGAATGTGTTGGATTGGGTCAGA
ACACAGTCTGCATCACGTACTCAGCTCATTTACCCCTATTTTATCACTAAACTCTGCCATAGATTTCACGTTCCAGTGTTCGCAGAG
GATAGGTTAGAAGGAGGGAAGGGGTTACTAAATGATCAGACTGTGAGGAGGAGCATTTCAGGCCGAGATCAGTCCGGTCCTTCAGGT
AGAGAGCCTCCTCAGCACCAGCCAGTTACACAGGATCCTATTCGAGAGGAGATGGACAGAATGCGGAGTCACATGGATAGGATGCAG
ATACAGATGCACAGGATGCAGCGGAATATACACGAGATACATGGTCAGATGAGATACTCCACTGATACCCTGGCATATTTGGTGAGA
GGATGGCAGAGAGAACATGGAGATACAGATGGACCTCTACCTGAGCTTCATAGTTATATCACACCATTTCAGCCAGATGATTTCCCA
AGAGAGGATGAGGCGGGACCGAGTTCAGCAGCTGCCGCTGATGATGTGGATGACGATATATCAGGAGATGAGCAGTGAGGGATGTTC
TTTTTATTTTACCCTGTCTTTGATTTTTATTTCGGCATGTACTTATTAAACTGTGATATTCTAGATATTATTTGCCTTGAGGACACT
GCAAACTCTGGTATGGGGTATAAGCTACTTAGCTTTTGTTTATATTTTTCTAATTAGTATTTTGTTTCAGTTTTTTTCTCTCTCA
GCATTTATCTTTTGTTAGTTTAAAATTTTTTTTTTCACTTACCAAATTAATAGAGTTAAGTAATAATTGATCTAATTGATAGATTTT
AAATTTTCTAATCCTTAGTTAGTGACATACTCAAGTTCACCTTTTATTATAACTCCAAATAAAATTCTTAAGAAATAATTTTTCAAG
TAGTATACTTTACTTAAGTCTTATCTTAGATTTTTTAATTAAAAATAATAAAATTTTTCCATGCTTAACTCAGAGTTGAAAAATATTT
TTTTTCAAGTTATCTTGATTTACACACTTTTTTCAGACTATATATACTTACACACATATATAAAAAAAACTAACCTTATAAAAGAAG
AGTGCAAAAAATGGCCACAAAAAAAAAAACTCTTAAATTCAAGGTGATTCTATCTTATAAAGCCTAAGTTGACTGAGTAATTAAGCCC
AAGGAGTATCTCTATACTTCATGACCTAAGCCCAATTGGGTTGGGATTCATTGGCCCAAAACTCATTAAATGGTCACTTAGAAAGCC
CGTTAAAATAGAAAACAATCACCAAGAATTAGAGAGTGAAAAAAAAAATATATATAACACTAACCATTGTTTATATATATATATATTGT
TGTTTTGTATATATGGTCTTGAAAAACAATTTTTGATCAAGAGACTTGAAAGTTATTTAAAACAAAGAGTTGGCATGTTCTTTTCAA
AACTTTTTAATTAAATTTCTAAGATTTGACTTGGTTTTGTATTGCTATAATGAAAAAAGATTTTCTAGGGGATTTACATTGGAGTTAT
ATATAAAAACCGTTTCTTGATTATTAACTAGCTTCAATTAGAATGTTTAAATATATCAAGGAAAATCTGTTATTTACTGACTTATTT
AACTTGGCAAGTTGACCGAATTTTATGGGTATATCACCGCAAACCCTCACCGAGACTACAACTCGTCCACTAGGGTAACCTAGGGGTT
TAAAGGCTAGTTGTATGCGCTAAATACAACCTCGATTCCTGCGAAAGTGAGTTAGGATTTTCTTTTTATTTTCTTTGCTAGAGGACT
AGCAAAAGTTTAGGTGTGGGGCTATTTGATAATCACATTTTATTACAATTTTATACCCTCATTATCTATTTTATATGAATAAATATA
CCACTAACAATTGCTTTTATCTTTAATTGTAGGTTAATGAAGAATAAGAGCCCAAACTCTCATCTCTCAACAAAAAGCCCTCGATTT
AATAAAGAAATGAAGCCCATGAAGCCAAAGGAATTCTTTCAAATATTTAATGAAGAAATAATTCAAAGCCCAATGGAAAATCAAGAG
AAAATGCCAAGCCCAAAAGTCTAAGCCAAAGCCCAAGATACAAGCCCAAAAGCCAAATACAAGAGTTCTGCGGACAGCAACCAGAAG
AAGGTAGGCATCGATGCCTGCATCGATGCCTGTATTGATGCCTGCATCGATGCTTGTATCGATGCCTGCATCGATGCCATCGTACAG
TTTGTTATAGATCTAAGGCTGAAATTTGTTATTTTGGATAAGATTTCAATCCAATGGCTCTCATTCACTGATGTTTACTATAAATA
GGGGTAGAGAGTGAGGGGTTAAGGGTGTGAAAAAATTTGTAACTCTATTTGGAGAGGAGGGCTACTCTTAATTGAGAAGGCCTTCCA
AAAATTGTAACTTTTATTGCAATTAATAATAGTAATTTTTCTCCTCTTTAAATTTTCTTTTCTCCTCTTTGTTGAATGATGAGGATG
GAGATGAAGAGCAATTTGAAGGTTTGTATTTCTTTTATTTTTCTTTTTTTATTTCTTTTTAGTAATTTCTTTATTATTGCTTATTAG
TTAGATTTACATTTATGCTTGTAGTGTAGATTTATTTTCTTGTCTTTTTATTTCTTTTTGTACTTTATTTTGTAGAGTAGATTTATT
TTCTTGCATTTAATTTCTGTAATTTATTTTGTCTTTTAGATTTTTATTCTTTGTAGTTAGATTTATTTCTTGTTCATTGTTTAGATT
TTTCTTTTCTTTTTATTTTTGTAATTAGTTCTTTTTTCTTCTTTTTTTTTATTTCTTAAGATGTGAAATTAATTCTTGTAGGAATCT
TAGAATTGCATAAAACTAGTCTAATTTCCTTTATATTGTATGAATTTTTCTCTTTCACTTAAAATGTTCATGTTTAGGATAATCAAC
TAGAGAACTAATCGGTAGAAGAAGAATTTGATAATCTATACTTATCTTAAATGGTTTGATAGGTTATGCTTATGAATTCTAGGATTA
TTATCTTATTGTTGTTCTTATCATGAATAGTAATTTTAACTTAGATGATAATTTGATAGGTTATACTTTCCTTAAATGGTTTGATAG
TCTATACTTAATAAATCTAAGTTGAATTATGATAAAAAGAGAAGAGTTTGTATTTTGTAATTAAAATTAGCTAGTGGATTATATTCT
AGATTTCTTACCTCTTGTGAATCCTCCATCTTGACTTTCTTTAATTTTTCTTTTTATTCTTGAATTTATTTCTTGATTTTATTCTTT
CTTCTTTCTTGCCTTGTGATTTCATTCATTCTTTGATTCTTATTTCTTTTCTCTAAAATTCAATTTATTGTTATTTGCACATAAATC
AAAACAGCCACTCATCATATCTCTCATCACAATCACACTTATTCTTTAATCCTATCTTGTCACGCATAAAACATAAGAACCAATTCT
AATAATCTCTTAAAATCATCTTCCTCGTGGGATCGATAACTTTTTATACTATAACTTGATCAATTGTGCACTTGCAATTTTGGTACA
TAATTATGCCGCATCACCACCTAGAACCCACGTTAAACAAAAGAGAAGATGAATTAATCTTCTCTTCATCTGTAATCGAGAGAGAGC
GTGAGTGATTGTAAGGGTTTCGTACCAAGTGATTGAACCTATTTCTTAAAACAAGAAAATCAATCCCAACATCAATTTTTTGACCCA
ACACTCATCGAACGTGATATCTCTCCTTAGCACAATCTTCCTATCAACTGGATCTCAAAGCTTGTATCCCTTGACACCAAGCTTGAA
TCCTATAAATATGACCTTCCTAGCTCGAGGTTCCAACTTATTAGTCTTCACATGATAGTATGCAGGCCACCCAAATACCTTGAGCTA
GTCATAATCGTGTGCTGGCTCTCCCGATCACATCTCCATAGGGGTCTTCCCCTCAATCGCAGATGAAGGCATCCTGTTAATGAGGTG
GCTTGCATATGAAAGGCCTCAGCCCAAAAGATCTTCTCCAAACTACTATGTGCCAACAAACATCGTATCTTCTCCAACAAAGACCGA
TTTAACCTCTCTGCTACCCCATTCTACTGTGGTGTTTGACTAACTGTGAAGTGTCTCTCTATGCCCTCGTCTCGACATAACTGCTGA
AAGGGGTCTGATGTGTACTCATCACCGTTATCGGATCGTAACGTCTTGATCTTTCTCCCAGTCTGGAGTTCCAACCTCTTCTTTCAC
TCCACAAATATATCTAGGACTTTACTCTTCTTCACCATGGTGTACTCCCAACAACGCTTAGAATAGTCATCAACAAACATGACAAAC
CGATATCTACCACCAAGTGATGCAGTCTTGGTGGGACCCAAACATCTGTGTGCACATAATCCAGGATGCCTCTCGTCCTATGAATGA
CTGTCCCAAACTTCACCTTCGTCTTCTTGCCAAGAACACAGTGCTCACAGTGTTAGCCCTTATGTTTTGATGATATTTTACAACCAC

Fig. 13BK

CATTATCGGTACTAATAGTTTATTGAGTGAAAATGTAGCAAATTCATTTATCAAGCTCGTTAGTGCCATTAACGGAGGATGGATGGA
ATATACCCTACAACGAAGATATCCAAAGGAGGAGGAGGCCAAGAGATGAAGCAACGTTATTTCAAGAACGTCAAATTCGACTAAAAG
CTTCTTCCGATTCAAGCTATATCAAAGCTCAAGTATTGCTCTCTATATGAGGATATTAGCTTTCTTTTGTTTCCCTCTCTAGTGCTA
GAATGTAGGCAAAGAGTTACTAAGTTTACTTGAAGCTATTGGGAATCACACACACGATTTCATACTTATGTTTTTAAGCGTTTTTCA
CAAAATACTATTTTTCACAAGTATGAGGACCTATCTGCAAAATTCTTTTTCCAAACAGTTTGTTTTTAGTATTAAAAACATTTTACA
AAGTTTCAGATTTTTCAGAGGTCAAATAAATATTTTGCAAATATTTAAAGTTGGTCAAAAACTGTTTTCTGCAAAATGTCAGAAAGC
GGTCGACCGGTCCGGTCGACCGCTCCCATCGCCTTTCCTCACTATTTTCCAGAGAGGTCGTCGGTTGACCGGTACGGTCGACCGAAA
TCTTGATTTTCAAATCGGTCGACCGTGCCGGTCGACCGACGATGGTTCTGCTTGTTTTCCAAGTTTTCGAAGCAGCTCGCGGTCGAC
CGAATTTTTCGGTCGGTCGACCGACGTGATTTTTCGGTCGACCGAAGGTTTATTTCGGACGACCGAAATTTCCTTCAGTCAACCGCG
ACTTTTTAAAACGGTCTTCTGCCTTGATCACCGTGCTTTCACTTAATGGTGATTAGCACAGTCTGGGCTGGGAGTCTGAAAAGGAG
ATTACTTGCTCATTTGGGACTTTTTTCTTCTGCTGTGAGGGTGAGATCTTGTGTAAGATCTACTGTGAGGGTGTGATCTGTTGAGAT
CAAACTGTGTAGTGAGAGAGATCGTGTGGGATCGCTGTGTAGACGAAGTTCCGGCTTCCAAACCGGGTGTGTAGTGGATTTCTCCTC
GAGAGTGGGGAGCGGGGACGTAGGCCAGAGGGCCGAACCTCGTTAACACATCGCGCGTCAAGGATAACGAACTCCTAACCCTATCTC
TCTTACTTTTATCGCATTTTTGTTTTGTGTTTTGCTTGTGCTGAATTTATATTGCATATTAGAGCCTCTTGACCCTAATCACCCCCC
CTCTAGGGTCCAACAATTGGTATCAGAGCTTGGTCTCTATATCAGTTTTTAGTTTAATCACCTTAGAGAAAAGATCTAATGGAGCCC
TCTTTGAATATGCATATGTTAGAAGGACAATCCACAACTAGACCACCACTCTTCACAGGGACTAATTTTGCTTATTGGAAGGCTAGA
ATGAGAATTTACCTTCGTTGCATTGATCTTGACATCCTAGGGCTCATAGAAAAAAAAATATGTAGAGAAGTCCAAAAATTGAGAACAT
GTCCGATGATGAAAGGCACCTTGCCAATCTCAATGCTAAGGCCATGAACGCCTTAATATGTGGTCTTTCCCCAAATGAATACAATAG
GGTTTCCACGTGTGCAACCGCATACGAAATTTGGCAAAAAATTATGTGTCACACATGAAGGAACACCCCAAGTTAAGGAATCTAAGAT
TAGTGGACTCATGCATGATTATGAGCTATTTAAAATGCTTCCTAATGAATCCATTGATGCTATGTTTTCCCGTTTTACTAATATCAT
CAATGAATTACATGGTCTAGATAAGCAATTATCCATTCAAGAGATGAACTACAAGATACTTCGCTCATTGACTCCGGCATGGGAGCC
CAAGGCTACGGCCATTGAGGAAGCTCATGACCTCACTACCTTAGCTCTTGATAGCCTTATCGGAAAGCTCAAAGTGCATGAGAAGAA
GCTCAAGGCGAAGGAGAACGACGAAGTGCCATCACGAGAAGTTGAGGAGCCGTCACCAAAGTTGAAGACCATAGCTCTCAAAGCAGC
TAGTGACAACTCATCTTCATCGTCGGAGAGTGAAGTCGATTTTTCTAGAGAAGTGGCTCTCATCTCTCGAAGAATCTCTAGACTTAT
AAAAATGAACAAAAAAATTTAACCCTCGATCTAACAACAAGTTTTCCTCTCGTGTAGGTAAAAATTTTGAGTGCAATGAACCGGGTCA
CATCGCTAAGGATTGCCCCAAGCTCAAAGAAAAGTACATGAAGTACAAGAAGAAGAAGGCTATGTATGCCGGATGGGAAGAATCCGA
ACCAAGTGACTCGGATAGTGATGAAGAAGGAGCCAAACTTGCTCTTCATGACCCAAATGTTTGTTTCATGGCAAATGAACATGAGGT
AATATCCGAGGCCGAAAGTGAATCTTTTTATATGCAATGTGACATAGCTATGGCTTTAGAAGAGTTGAACTTTGAATTTAAAAGAAT
GTCTAAAGAATACTCTTCTTTCAAAAAATTGCATGCCTCTTGTGATATTAAGCTAGAACAACTAACAACCTCTCTTGCTCTTAAAGA
TGAATTGCTAGGAGATCTCGATTTCGAGAATAAGCAATTAAGATCAAAGATTGAAAGATTAGAAATTGAGGTTGTAGGACTAGACC
CACTCATGCTTATGCCAACTACAATCACCATGGTAGAAATAGGTTTCATGGTTCTAACATTCGTACATACAAAAGAAATTTTGTATG
CACCTATTGTATGAGACATGGACACATTTCTACTCATTGTAGAATTAAAGACAATGAAGATTTTTATGGTTTGATATGGGTACCCAA
AGGTACCAAAACTACTAACCACCAAGGACCCAAGACATGGGTACCTAAAGCTACTACACCTTCATCTTCTTCTTTTGTAGGGAACGT
CACGGCAACGACGTAAGGAGATGTGGTACCTTGATAGTGGTTGCTCACATCATATGACGGGCAACAAAGAGTTATTTGCAACCCTAT
CAAGGATTGAAGGAGGCAATGTCTCCTTCGGTGGTGGTGAGAAAGGTAAAATCATTGGTATCGGTTCTATTGGTAAGAAACCCTCAC
CCATTATTGAAGATGTCTATTTAGTAAGTGGTTTGAATCATAATCTTCTTAGCATTAGCCAATTAAGTGATAAAGGTTTTGATATTT
CTTTTAAACCGGATAAATGCATCATTAGTATGGATGGAAAAATTGTTTTTATTGCAAATCGCAAGTCTAATGTTTACATTTTTGAGA
TGAATGAGTTAGTGAATCAAGATGTGAAGTGTCTTGCGGCAATTGATGAAAATCCTTGGATTTGGCACAAGAGACTTGGACATGCAA
ATATGGAGTTAATATCAAAATTGTCTAAGAAGAATCTTGTGAAAGGGCTACCTAGCTTGCACTTCATAAAAGATACAATTTGTGAGG
ATTGTGCCAAAGGTAAACAAACAAAGTCTTCTTTCAAATCCATCCATGAGGTATCGACTTCTAAACCCTTGCAATTACTTCATCTTG
ATTTATTTGGTCCTATGCGTGTTACCTCTCTTGGAGGCAAACACTATGTTTTTGTGATTATTGATGATTTTTCTCGTTTTACATGGA
CAATATTTCTTGCAAAGAAAAAATGATTGTTTTGAAGAATTTGCTAATCATGTTAAAAGAATTGAAAATGAAAAGGATTTGAAAGTTG
TTAAAATAAGAAGTGATCATGGTGGTGAATTTCAAAATGAATTTTTCTATGATTTTTGTGCTCATCATGGTATAACTCATATGTTTT
CCGTTCCTAGAACACCACAACAAAATGGTGTTGTTGAACGGAAAAATCGTACCATACAAGAGATGGCACGCACTATGTTAAACTCAT
TTGATTTACCAAAATACTTTTGGGCGGAAGCTGTCAATACGGCTTGCCATGTTTTAAATCGTGTTTTGATTAGACCAAAGCTTAAGA
AAACTCCTTATGAACTTTATTATGGAAAAACTCCTTTCATTGGTTATTTTCGTGTCTTTGGTTGCAAATGCTTTATTTTAAATACAA
AAGATCACCATGATAAATTTGATTCCAAAATTGATGTTGGTATTTTCTTGGGTTATGCACCTCGAAGTAAGGCTTATAGGGTCTTCA
ATAAACGAAGCCTCGTTGTTGAAGAGTCTATAAACGTTACTTTTGATGAGACTAATGTTGGCTCTCAAGTTGTCTTGCCTAGGAAAG
ATGATGATGATGATATTGAGGGAGGATTGGACTTGTTGCAAATCAATGACACTCCCTCTATAGAAGTTCAAAAGGATGTAGATAGCA
CCAATGCTCAAGAACAAGTTGAACCACCTAAAGCTTGGAAATTCACATCAAACCATCCAAAGGAACAAATCATTGGGAGCCCTTCAA
AAGGAGTTATAACTCGCTCAAAAGCCTTGAGTGAATGTGGTAATGTTGCATTTCTATCTCAACTAGAACCTAAAAAGGTTAATGATG
CTTTAAATGATGAGTTTTGGGTTTTGGCTATGCATGAAGAATTAAACAATTTTCAAAGAAATGAAGTTTGGAAGTTAGTTCCTAGAC
CTAACAATGCTAGTGTTATTGGTACAAAATGGGTTTTTAGAAACAAACTTGATGAACATGGCATTGTAACTAGAAATAAAGCTCGTT
TGGTTGCCCAAGGATACAATCAAGAGGAGGGCATAGACTATGATGAAACCTTTGCACCGGTTGCAAGGTTGGAATCTATTAGGATGT
TTTTGGCATTTGCTAGCTTTAAAAATTTCAAACTTTTTCAAATGGATGTTAAAAGTGCCTTCTTAAATGGCTTTATACAAGAGGAAG
TGTATGTTGAGCAACCCCCCGGTTTTATAGATCATGCTTTTCCTAATCATGTTTACCGGGTACAAAAAGCTTTATATGGGTTGAAAC
AAGCTCCTAGGGCTTGGTATGCTCGCCTCTCTAGTTTTCTTATTGAAAATGGTTTTTCAAAAGGAACAATTGATAACACACTTTTTG
TGAGAAAAAGGAAAAATGATTTCATTTTAGTTCAAATATATGTGGATGACATCATTTTCGGTGCTACTAATGAATCCTTGTGCAAGG
AATTTTCTAAAGTAATGCAGGATCACTTTGAGATGAGTATGATGGGAGAGCTTACATTCTTTCTCGGGCTCCAAGTCAAGCAAACTA
AGGATGGGATCTTCATTTCACAAAGCAAGTATGCGAAGGAATTGGTGAAGAAATTCAAGTTGGAGAATTCTAAGCATGCGCCTACTC

Fig. 13BL

CCATGAGTACTAGTGTTAAGCTTGATGCGGATGAGAGTGGTGAAGATGTGGACCAAAAACTATACCGAGGTATGATAGGTAGTCTTC
TTTATCTCACCGCTAGTAGACCCGACATCATGTTTAGTGTATGTGCATGTGCACGTTTTCAAGCCTCTCCCAAAGCGTCTCATTTAA
TTGCGGTTAAAAGAATCATTAAGTATGTTAATGGAACTTTTAACCTTGGCTTATTTTATCCAAGAAGCACCTCTTTTGATTTATATG
GTTTTTGTGATGCCGACTTTGCCGGATGTAAGGTAGATCGCAAGAGTACTAGTGGAACATGCCAATTCTTAGGAAATTCCCTTGTTT
CTTGGGCTTCCAAGAAACAAAATTGTGTTGCATTGTCCACTACGGAAGCGGAATACATTGCCGCCGGCTTATGTTGTGCTCAAGTTT
TATGGATGAAACAAAGTTTAGTTGACTATGATTTGAATTTTCAAAATATTAAAATCTTTTGTGATAACACAAGTGCTATAAATATTT
CCAAAAATTCGGTTTTGCATTCTAGAACTAAACATATTGATGTACGCCATCATTTCTTACGCGATCATGTAGAGCGACAAGATGTAT
CCCTAGTATTTGTTGACACCAAATCTCAACTAGCGGATATATTTACTAAGCCTCTTGGAGAGGATGATTTTTGTCGCATAAGAAATG
GTTTGGGCTTATGCACTATGTGAAAGTTCTACATTGCTTGCTTGATTAGTTGCATTTTGCATTTGGCATTTCTCTTTACCCCATTTT
TGATGGTGACAAAGGGGGAGAGAAATCTCCTCATTTGTTGCATATATTTAGGGGGAGCTCATAGATAGGGGGAGCACCTATCTATAA
GCTATTTTATTTTTGCTCTTATATAATGGTTGGTTGTCATCATAAAAAAGGGGAAGATTGTTAGCCCCTTATGTTTTGATGATGTTTT
ACAACCACCATTATCGGTACTAATAGCTTATTGCGTGAAAATGTAGTAAATTCATTTATCAAGCTCATTAGTGCCATTAACGGAGGA
TGGATGGAATATACGCTAAAACGAAGACATCTAAAGGAGGAGGAGGCCAAAAAGATGAAGCAACGTTATTTCAAGAACAACAAAGCC
ATATAAAAGCTTCATCCGATTCAAGCTATATCAAAGCTCAAGTATTGCTTTCAATATGAGGATATTAGCTTTCTTTTGTTTTTCTCT
CTAGTGCTAGAATGTAGGCAAAGAGTTACTGAGTTTACTTGAAGCTATTGGGAATCACACACACCTTTTTAGACTTGTGTCTTTTAA
GCGTTTTTTCACAAAACACTATTTTTCACAAGTATGAGTACCTATCTGCAAAATTCTTTTTCCAAACAGTTTGTTTTTAGTATTAAA
AATATTTTACAAAGTTTCAGATTTTTCAGAGGTCAAATAAATATTTTGCAAATATTTAAAGTTGGTCAAAAACTGTTTTCTGCAAAA
TGTCAGAAAGCGGTCGACCGGTCCGGTCGACCGCTCCCATCGCCTTTCCTCACTATTTTCCAGAGAGGTCGTCGGTCGACCGGTACG
GTCGACCGAAATCTCGATTTTCAAATCGATCGACCGTGCCGGTCGACCGATGATGGTTCTGTTTGTTTTCCAAGTTTTCGAAGCAGC
TCGCGGTCGACCGAATTTTTCGGTCGGTCGACCGACGTGATTTTTCGGTCGACCGAAGGTTTATTTCGGACGACCGAAATTTCCTTC
AGTCAACCGCGACTTTTTTAAAACGGTCTTCTGCCTTGATTACTGTGCTTTCACTTAATGGTGTTTGGCACAGTCTGGGCTGAGAGT
CTGAAAAGGAGATTACTTGCTCTTTTTGGAAGATAGGGTTTTATTTTAAAATGATTTAAACTCTTCTATAAAAAGCGTTCTGTTTCC
TGAGAAAAATTTTCAAAGCCTGTTTTCTCTCTGTTTTAAGTGTGTTTCACTTCCCAGCTTCAGTAAACCTTCTCTTTGCTATAGGGG
CTGTGTAAAGAGAGGTTCTTGCATCTTTTCTTCTGCTGTGTGAGTGAGATCTGTTGAGATCAACTGTGAGGGAGAGTGATCTGTGAG
ATCAAACTGTGTAGTGAGAGAGATCTGTGGAGATCGCTGTGTAGACGAAGTTCCGGCTTCCAAACCGGGTGTGTAGTGGATTTCTCC
TCGAGAGTGGGGAGCGGGGACGTAGGCCAGAGGGCCGAACCTCGTTAACACATCGCGCGTCAAGGATAACGAACTCCTAACCCTATC
TCTCTTACTTTTATCGCATTTTTGTTTTGTGTCTTGCTTGTGCTGAATTTAAATCCACCACTAGACCACCTCTCTTCACAGGACCA
ATTTTGCTTATTGCAAGCTAGGATGAGAATTTACCTTCGTTGCATTGATCTTGACATCCTAGCGCTTATAGAAAACAAATATGTAG
AGAAGTCCAAAGTTGAGAACATGTCCGATGATGAAAGGCACCTTGCCAATCTCAATGCTAAGCCATGAACGCCTTAATCTGTGGTC
TTTCCCCCAATGAATACAATAGGGTTTCCACGTGTGCAACCCCATACGAAATTTGGCAAAAATTATGTGTCACACATGAAGGAACAC
CCCAAGTTAAGGAATCTAAGATTAGTGGACTCATGCATGATTATGAGCTATTTAAAATGCTTCCAAATGAATCCATTGATGCTATGT
TTTCCCGTTTTACTAATATCATCAATGAATTACATGGTCTAGATAAGCAATTATCCATTCAAGAGATGAACTACAAGATACTTCGCT
CATTGACTCCGGCATGGGAGCCCAAGGCTACGGCCATTGAGGAAGCTCATGACCTCACTACCTTAGCTCTTGATAGCCTTATCGGAT
GATAGTCTCATCGGAAAGCTCAAAGTGCATGAGAAGAAGCTCAAGGGGAAGGAGAAGGAGGAAGTGCCATCACGAGAAGTTGAGGAG
CCGTCACCAAAGTTGAAGACCATAGCTCTCAAAGGAGCTAGTGACAACTCATCTTCGTCGTCGGAGAGTGAAGTTGATTTTTCTAGA
GAAGTGGCTCATCTCTCTAGAAGAATCTCTAGACTTATAAAAATGAACAAAAAAATTTAACCCTCGATCTAACAACAAGTTTTCCTCT
CGTGTAGGTAAATGTTTTGAGTGCAATGAACCGGGTCACATCGCTAAGGATTGCCCCAAGCTCAAAGAAAAGTACATGAAGTACAAG
AAGAAGAAGCCTATGTATGCCGGATGGGAAGAATCCGAACCAAGTGACTCGGATAGTGATGAAGAAGGAGCCAAACTTGCTCTTCAT
AACCCAAATGTTTGTTTCATGGCAAATGAAGATGAGGTAATATACAGAAGCGTGCTCGCTCACCAAACAAGTCGTAAGCATGAGAGA
AGAATAACCAATCACACACGAGCACAATCCAAATACAACAAATCAAACCAAACACAGAGATATACGTGGTTCGGCAATTTGCCTACG
TCCACGGGGAGAGGATGGGGAGATTCCACTAAATCAAACAGAGTACAAAGGGTTACAATCTCACAAAACTCACAAACTAACCCTCAA
CCAAAGCTCTCAACTTGCTCACAATATCTCCCTCTCACAATGCTCAAAAGTCTCTCTAATCTCTGATTACAACTCTCCTCTTTTTGA
TTGATCCTAATCTCTTCTAAGGCGTTCCATATATATAGAAAACCTAAAACCAAAACAGACTAAGAATCCTAAAACCAAAAACAAAAC
AAATTAGGAATCCTAATAACCTATTACCAAAACAGATTAAGAATCATATTACCAAAAAAGATTAGGAATCCTAATAACCTCATGTTA
CCAAAATAGATTAGGAATCCTAATAACCTGTTACCAAAATAGATTAGGACCCTGCTATCCAACAAATAGGTTTTGACATGTGGCTTT
GGTCAGCTGTTTTTAAAGAAGCGTCTATGATCAAATGCCTTAGTGTGACACTTGAGGGCTCAGAGAGTAAGTGAAATTCTTCTTGAC
TTCGGTTTTGGAATACGAGAAGATTCTCAAACATGGGATAATGAGAATGGTCCGTTCTTGTCTGAGTATTATCCGACCCGATGTCAC
CACCTGGAGGAATCGGAGTAAGAGAATGCAAAACTGCAAAGGACAAATCAATAAGGTTAGCCCAAACAAGTAAGATAGGTGGGACAT
TGGCTAAAAAAATTCACCCAAAGAATGGCACAAGCCTCATCAGACTGGCGAACTTTGTTTGACAGATGAACCTCATCCATCAAGACG
AACCTCGTTAAATAGATGAATGTTGCTAGACAGACCAACTTCGTTTGACAGACGAACATCATCCAACAGACAAGCCTCGTTAGAAAA
GACGAGACTCATCAGATCGACAAGCCTCGCCTAACAAACAAATCTCATCCGTCAAACAAGCTTTGTCTCAAAAAAAAGGAAACTGTT
CATCTTCCTCGAAGACTCAAGCCTGAAATAGGCAGAGTTTGATAGTTCTAAAATGTAAAACTTGCGTTCGATTGCAATACCTGAGAA
AATAGGCAAAGCGATCGGAGCTAGAGCCCCTTTTGCCTTTGCTTTTGCCAGCGGTGATTTTTGGGGCCATCAGTGCGAAGTCTTGTG
AAAAAATCAAAGGCAAAGAATCTATGCAGACGAAGCACCTAGGGTTCAAATGTTTGAAGAAGACGAAAAAAATTTCGTCAAAGGCGG
ACGCTTATTTATAGGTAGAAAAAAAATCAAATCAGTGGCCGAGATCTACGGCCAAGATCTGTAGATGAAATCTGTAACAGACAAGAT
TTGTAGACGAAATCCGCAGAACAAATTTCAGAGTGCTAGCTGGCGACCACCTATCAGGCCTAGAAAAGGTGCGATGATGGAGACCAT
TGCATTTAATGCTGACAAAATGAATTGTCAGACCAACATGGGCCTGACAAAGCTCATATGGAGTGGTGAGATTCAACAGAATGTCGA
GCCTCGTTTCGAAGCGTCCAAGCTCACCTAGAAATGGCGAATCGCAAGGTTCATTCTGAAGCGTTGAAGCTAACCAAGAGAGCAAGT
TCATCATACGAACCAAACTCATGGTAATCAGAAGGGGTTCAAAGTATTTCAGACCCCATGCAACCTAATTCAGGTCTGAAAACTTTG
AAGGAGGTCTTGTAGGCACTAAAAAACTACCAAAAATCAAAGGAGCATCAAAGCTCACCACAAGCATGACGAGGGTCATTACTATGA

Fig. 13BM

CAAACCTCGTCTTAAACAATGAAGCTTGTCATTGGAGACAAAGTCCGAAGCTCGTTAATGAAGAAAAAACTCAAGCTCGTCAGTGAA
GATAAAACTCATTATTGAAGACGAAGCTCGTCAGTGAAGACGAAGCTCGTCAGTGAAGACGAAGTTCATCAGAAGAAGTCCACAAGG
CTCATCACGCAATTGGACTCAACCATTAAGGATGAAGCTCGTCAGTGAAGACAAAGCTATTTCAAAAGACAAAGTTCATCTCATAGC
AAAGTTCACTCTGTTAGACGAACCTCGCTGCGTATCAAGGCTTGTCTTATCAGAGGAACCTCACAATGCAGTGAGGCACGTCATACC
GTATGAAGCTAGACTATAACGGTCTTGTTGACCTAGTCAGCCCATGTGGGCTAAATTTAGGGAGTCAGTTATGCCATGACTCCACGA
TTTCAGCCCATCAGTTACGAGCTAAGGCCTATAAGTACCCATGATCAATTATGAAGGACATACTTTTTTTTTCTGCCCATGGCTTGG
CAGAGCTCTTGCACTCGAGCTTGAAGATCCAAACCTAGGTTCTTGTGGTTAAGAATCAGTAGTAGCTACCGACAGCGGCTCAAGTAC
TTGACCATGCATTCTTGTTCTGATAATCAATGGGAAGCAAGCTCGACTCAAGCATCGAGTGAGGCATCCTTTCGCCACCCAGAATCC
ATATTAAACAAAGGAGAAGTCGAACCAATCTTCTCCTCTTCTATAATCGACTAAAGAGTGATTGTAACGAGACTCTTACTAACCAAT
AGAGTATTTTCTCCAAAGCTAATACAGTTGAAGGAATCAATCAATCATTTTTTTTACGACCTACAAAGTCATGTAGTCGGCGGATGA
TGATGATGCTTGTCCTGCAGCAAGCAAGCGGCTGATCTTCCCATTGGTGATGTAGAGAGACCCCTCGCGTTTGCCGTATGCTACCAC
CAGGGCACCCTTGGACACCTTCCAGCTTCCCTGCTTGAAGGATAATCTGAAACCAGAGTTAGTCAGTTTCCCGACTGATATAAGATT
CTACCTGAGATTTGGTACACGCTGAACGTTGTTCAGCGTCAAGGTGGTCCCGCCCTCCATCTTGAGGGTACAATTTTCCTTTCTGGA
GACCTTGCAAGGTTGATCATCACCAAGATAGACTATCCCAAGTCCTTCTTCATGAACGATGAAAGCAGCTTTTGTTGTGAGGTTGC
ATGGAAAGATGCGCCAGAGTTGATGACCCACACATCGTTCTTATCTTCAAGAGATAGAAGAAGTGCATCCAAATTTGTCTCGTGCAT
AAAATTGGCTGCACCGTCAGCCTGATCATCCCTTTCTGATGCTAGAACAAAAGCTCTGTAGTCCCCTACAAAGTGACCCTTCTTTCC
ACATATAAAGCACTTTCCTTCACCGTAACCATTCGGGTCCGACCCTTTAAACTTTCCTCTGGACTTTGACCAGCCTCGTCATCCCCT
ACCCTTCTTCTGTGCACGCCCTCTTGCCTCGACATGCAGAGCACTCCCAATGCTAGAGGTCTCAACTCCTAAGACTTTGCGGCGAGA
TTCTTCATCTAGAATTGCCCCAATCACCGTGTCGAGCTTCATCTTGTCATTGCCATTGGCATTGCTCACCGGCATCACCATATTCTC
CCATGAATTTGGTAGACAAGAAAGTAGCAGAAGAGCTTGGATCTTATTGTTAAACTTGAGATCCATTGCAGCAAGCTGTTGCACCAC
AGCCTAAAATTCGTTTAAGAAGTCCGCTACGCGAGCTCCTTGCTGCATCTTTAGATTGAATAGCTTCTTCATTAGGTACACCTTATT
TGAGGCAGACAACTTCTCATACAATGCCTCCAAGGCCTTCATCAACTCCTTAGTGGTGGTCCCATGCGAGATGTTGTAAGTCACATG
CTGGTGAAGGTTGAGCCTTATGGTGACAAGTGAAATTATCTTAGAGGGGGGTGAATAGGGTAATGTGAAAATAAATGTGCAATTAAA
ATTTGCCAATGCAACACACCAATCAAATTAAATGCAAAGGTAATAAATAGAGAAAGAGTTTAGAGAATAGTTATTGTTGATGTTAAA
TATCACACATCCAATTAGATCTAGGCTGGGATTGATTCTGGTCCGGAACTGGATCGGTCTCCTTTGAGTCCTCACCGGGACGTGGTA
AGGGAGAGTAATGGAGGGGCCACTACCTTCTTCGACTTTATTCCTAGTTCTTGAACAGGGGATTGATTTTCATAGTTTATAAAAAAA
AGGAGGCCGCTTTCTTCTTCGACTTTATGCCTAGTTTTAGAATTAGGATGCCCGAGCAATCTGCACACAAAAGAGTCGTAAGAGGCC
AGCGACCGGTTCCCCCATGGTTCCTTCGACGGTAAAGTTAGTGAAACTTGAGTGCGAAAAGGCAAGCTCAGGAACCAATATGGTTCT
TAAAGTGGCAATGTCTCTGCCAGAGGATCTACATGAGCTCCTTTGTCTAGACAAAGAACTGTGTGTTCTTGTTTTTCTGCCATGTAT
GCTTTTGGGGGGTTTTAGGTTATGAACCTCCTCTCTCCAGCTATGGTGAATAGCATCTGTATATAAATAGGATGTTAAGGGTAGATT
GGTCAATTCAGTCATGAAAATAATGGTGGCAAAGTGTGAGCTGGAAGGTGAGTCATCTCTCGCTTTACAGGTGTTGACTGACGACTG
GAGGGGAAGTCACTTCGGCACAGGAGAGGGTGTCTCCACATTTTTCGGGAAGTGATTGATGGTGCGGCAGAAGGCACGTGTGCATAC
TTGAATCGTCCCTCGCTTTATAGGTGTCGACTGGCGACTAGAGGAGAAGTCACTTCGGCACTTGGGCAGCTGACAAGTCACATAGAT
CATTAGGCTAAAATCTGGATAAGGTTTGTCTGACATGGATTGAAATATTAACATATGCTCTGGGGAGAGGCTTTAGGCTTGGGCCGA
GTCTTTAACTTAGTCGACAGTAGGGAATGTCCCTCAAGTCATCTCCGAGAATTACCCAGTGAGTGGTCGAGTGCTCTAAGTGGGTCG
CCCTCGGTGATAGGGTCGACTAATCCCACCTTTCATGTTGGCATAAAATAAGGTCGACTTGATGAGTTGGCGAGGTCGAGGCCTCCG
TTGGGCTTGGGCCACTCAAGTGGGTTTGAGGTTATTTTGTTAGGACTCTTATTATATCATTTTGTAAATGCCCATATCTTGGGTGAG
TGAACACCATAACAGTTGCCCCTTTCACTTGGAGTCGACTTTTAGTCAGCTCTGAGAGAAATAAGATATGTTCTGATCAATACAAGC
CTGCTGAGGACGAAAAAATGAGAAGTCTTTATCGAGCATCCATTGTTGACTCTGCTTTTCAGAGCTGATGTTATCAAAGATCTGAAC
CTTCTTTTTAGGAGATGAAGTGTCGCGGACATAATGGAGCATCTTTCGCTTTTATTGTAATGGGACGTGGGGCATTAAATGAGGGTG
ACGTTTCATGTTTTGAGTGAACCGCTTCAGATTCCGAAGTGGATCGGGCCTGGTTGCCTCGAAAATCACCGCATCCTTTGAAATTCC
TCTATACTCTTCCTTGAAAGCTTATAAATAGCCTCTTAATGTCAAGATAATTCTTTTACGAACCTTTGCTTTGACAAATTCCTAATA
TTCCTCCAAGATTTTTTAAGAAAAAGTCTTCCATGGCCTCTCAAGTTTCAAACTCTGGCCGTAGTGAGGAGAGACTCGCTGTTCTTC
TACTTATCAGCTCGAAGGTCCATATGGATAATCTGTTGGGGTTGTATGATCAATACAATATCTCTCAAACTCTTACATTGGTGGCGC
CAGAGATAAGCGAGCCAGTATATTGCCATGGCGAGGATCAAGTGCCGCTATACCTAGCCCACTTGGAGCATGGCTTACGGCTGCCCT
TGCACCCTTTTATTAAGGAGGTGCACACTGCTCTAGGAGTCTCCCCTTTCCAGTTCTATCCAAACACAGTGGGGATTCTGGTGGCTT
TCATCATCATTTGCCATCGTGTTGGAGTCCAACCAAGCTTGAGATTGCTTGGGCATTTGATCGGCGTGGGGTCAGCTGAGAAGGACC
CGCATTACTCCTTTCACTATCATGGTGAATTCCAGCTTGTCTCAAATTCTTTGGAGTTGGATGAGGACTAGAGGAGCAATTTGTGTG
GGTCTATGGTGGCGACAATGTCTTCGCCTGCTCGGGCTGGCCGGAGGCGAATGAAGACGCGTTGAGGCTAGTCACCCTTAGTGATTC
CGAGATAATGGTTCTGGACAAGGTCTCTTTTTTATGCTGTACCATGAGAGAGCGATGATCTATTTGATGATGTGTCTCTCCAAACGG
TGGGCATATCTATGATTTTGTCTTCCACTGGCTTCCAAGCAAGGACGAGCCCCGTTCCTCTGTTGGCAGAAAGTCACAAGAGGAATG
CAGGGACCGAGGAGTTGAGTTCCACTTCTAGGCACCATAAAAAGCTGAGGGAGGCCTTCAGTGCTGAGGAGGTGGCTGTCTTGATGC
CTCAAGCCACTAAAATTGTCTTTGAATTAAGGAGGAGGACAAATGTCGAGAGATGGCGCCCAATCGGACCGATTGGGAAGCTCCAAC
CAACTGGGATCGGTTCACTGGTAAATTAGCTTAACCGCTTGGAGAATATGGGGTGGATAGATGAGTCTTCTCCTGACAGGGAGATAA
CAGCCTTAGCGGTCGAGGAGGATGTCGTCGGCCCTAGTACTATTCCTAAGGCGTCTCGTCGTCCTAAAAAGGAGCTGATTGGGATGG
ACAATAGTGTTGAGAGGAGAGCTGAAACTCCGTCAGACCAGATGGACAATGGTACTGACGGGAGGATTTTGGAGGATATGCTAAGTG
TTGGCATACACCAAGCTCTCGAGGTTTGTTTGGCTTGGGGACTTTGCTGGAGTGCACCTTATTTAATCGACTTGAGCGTTCCTTGG
AATGTCAAGTAGGCTTGGCTAAGGAGAAGTCGCCCAAGGAAGAGGCAACGAAGAGGATCACTATCTTGGAGACCGAGTTAGCTCACA
AAGAAGGCGTTTGGTGCCGGAGTCTGGATGAGAAGGAAGAGCTCCTTAAGAGCTTTCGAATCCAGTTCTCCAAGTTGGTGGAGACCA
TCAAGAACCTTCAAAGAGAGATGGTTCATCTACAGGCAGAGGTTGAGTCTGAGATAGTCGTAGGATGACAGCTGAGACAGAGGCTCA

Fig. 13BN

ATCAAGTCGCCTATCTCTCGAGAAGATGAGAAGGGACTTTGAAGAGATACAATCAAAGCTTCGGGCGTCCACAGCCCCTCGTCCAGAA
ACTAGAGAAAAAAAATCATTTATCTAGATTCAGAGCAGCATAAAAAGAAGGTGGTCGACAACTGACATCATGGTTCTATATGGAAAG
CCGAGATGGCCCTAGCATGTAAGGCCGGAGTCGATTACTTTGCTTCTTTAGTGCCTCGCAACTCTCATCCTACTTCAGATTGCTTCT
ATCCTCCCCGTGTTTCCTGCTATCTCGATTTGTTAAAAGATGTCGAGAAAAAATGGAGGCGGGTTGGATTTATCAACGAGTGATGATG
AGGTCGAACCTATTGCTGGGCTCCTAGGGAATCTTCTGCAACTGCCACCACCCGAATACCGCCAAGTCTAACTCCCAAATCTGGTC
GAGAGCTTTGAAGACCCGTATCTCTTCAATTTTTTTATTGTAGAGAAGTTTGTAATGAAGTTTACTCTTATTGAATGAAAATTAACT
TTTGTCTCCATTCTTGAGCTTGCCTTCATTATTTATATTCTTTTAGCTTTGTAACTTTGTTTTTGTTTGAAATATTGGCTGAAGCGA
GTTAGTTGTAATGTGTCGACCCATACTGGGGACTTATGACAACTAGTTCATCTGATGCCTTAGTTTGGCTGAGTGTTTAATTGACCA
GAACTTGACAGATGAGTGCTTAAGTTTTTAGATCAATTAAGTATTGGCCATACACTTAATATTCATACCTTAGGCTTATGAATACTT
TTTTTGGCAGAATGACAACCCTGAGGTTGGGTGCCTACGTCTTACGTAGGTGCCTAAGTCTTCATAATCCTAGTATTGTCGAATGCT
GACTGTGGGATTCGATCGTAGGGTTGTGCCTTGGGTTTATTCCTGATAAGGTACCAAGGACATGAAAATACAACTCGGAAGTCGAAC
GCCTAGGCTCGAGAGAGTCGACTAGGTCTTTCCTTCCCCTAAGGCTGAGAGACGACCGTGGGAGTCAGCAAAAGGTTGTGCCTTGG
GTTTAATCCTGATAAGATACCAAGGGCTTGTAATCCAACTCAGAAATCGAATGCCTAGGCTCGAGAGAGTCGACTAGGTCTTTCATT
CCCCTAAGACCGAGAGATGACTATGGGAGTCGGCCAAAGGGTTATGTCTTGGGTTTATTCCTAATAAGGTACCAAGAGCTTGTAATC
CGACTCCGAAGTTGAACCCCTAGGCTCGAGAGAGTCGACTAGGTCTTTCTTTCCCCTAAGGCTGTGAGACGACTATGGGAGTCGGCC
AAAGGGTTGTGCCTTGGGTTTATTCCTGATAAGGTACCAAGGGCTTGTTGGGAGTGCTTAGGTCTTTAGCCATAATGAAGCCTTAAT
CCCTACGAAATATGAGTTAATTCATATTCAATAAGATTTCACCAATTCTAAAATTTACATGATCATGAAAAATATCTTTTGTAGGTA
TCTGGTGCCCAAAAAGGGGGTTGAACCACTTGTGGTCTTGCTTTGTCTTTTTTTTCACAAAGGCAGTGTTGTAATGGATGAGGCTGC
CAATATAGAACCTCTCTAGTTGGATTTTGCTTGCTTTTTTTTCTTTTTATAGCGGACTGCTCAATGATAGATGAAGATGAGTCGAA
ACTCCATTTGCCATCTCATTAGCCAAGGTTCCTTTTGAGTCTGAATCTTCAGTACGGCCTTGAAGGCGGATGGTTAGTATGCCGGAT
TTTAGCAAAAGGAACTACCCAGACACCACGAATCATGTTGAATGATGTTTTCTAAGTCTGGTTCACGAGGGTTGGGGGCACGATCGG
AAGCTATATGGTACCTTTTGTGGTAGAAATTCTCTTGGAGAGAGAATCCACCAGCCGATATTGTACTCCCTGAAAATGACAAACCAT
ATCGGTTTCCTCGAATGAGCTTTAGGAGTACCGGGGACTGGAGCATGATGTAAATAGAGAACTCTCCCTTATGGGATCATGAGGAT
CATACGGGTCACATGCTTTGACCACCAGAGCTTAGGTAAATTTAGTGGTGCAGGCGTCAATTGAAGAACCAATGTCATTCTTCTTGA
GAAGACAATCAGCTGACAGGCCCTAAGTTTTTCCCACAATCTCATCCCTGATGTATAAGAGTTCCTTTCAAAAAGTCCTCATGGTCC
AAGGCGCCTATCACAGACTTAATCACTGCTCCTATGCTCATATGAGCTATTGACAGTTAGAGCTTAAGTAATATTTGGCCTGATCAA
ATTCTATGTTTTGGCTAAAGTTATTCTGTGATGGCGATTAGAAGCCAATGTTGCTTTTCAAGAAAGACAACCACCCTTATGGTGTGT
CTTCTTCTGGAGGGTTTTCAGAGGGGCTAGAGGTCATTCTACCATCTAGCAGATGGTATGCTTATTGGCCTCTTTGTTTTGATGATG
TTTAACAAATAATCTACCACTAATATTGTTTGTCTAGTGTTTGTGTTTATCTATTTATTATAAACAAACATCATGTTGGAGGATGAA
TGGAATCAAGCTTTCACGATCATATCCAATGGAGGTTGGCGGAATCGTGGGATGAAGCTACGCAATTCAAGTTAAAGATTCAAGTTC
AAGCTTCATCCCTAAGTGTACCAAGTCAAGCTTATTGAAGACCTATAGCTTGGGTAATCTAGTTTAGGAGTTTATATTATGTGTCTT
AAGTATTTTAAGCTCAATCATATATACACACACATTTTATTGGTTTCTTTGTATAGTTATATATATACATATATATTTTGGTTTAAT
AGTTTTCAAGTTTTAATATGAAACAATTGAATACAATTGAAAATACATTTATTATTTCATACTTATATGCATATATATGATTTCATC
AATATCAATTTTATTTAGTTTAATGAAATCATATTTATTGTTTTTGAAAAGTTTGCAAAATATGCAATTTTATAAAAATTTTGTATT
CTCAGTTTTTAGACTTAACAATAAACATATACATCTTTTATTAAGTCTAAAAAATCATTTTATAATGTTTCAAAACATGGTTAAGCT
AAAATATCAAAACTCATGTGTTTACACTTTTATGTTTTGGACTATTTTGAAAAATGATGATATTTTTCATTTGAGAGGTCCTTTTTA
AAAACAAATTTTTGTAACATGTTTATTATTATGTTTACAATCATTTCCCAAAGTTTTACATTTTTTTGATTTTATTTGCTATTTTTA
AAAGATGTTTGAAAATTAGATTTCTGTTTAAAACAGACTGTGTGCATGTCTTGAGTCGACTCATGAACAGTGTTGAGTCGACTAATA
AACTGTCGTGTAGTTTACATTTTGTTTCTAACGAGTCGACTCACAACATCATAAGTCGACCCATCAGGTTGAGTCGACTCATGCCTG
TTATAAGTCGACTTCTATCTCTAACCCTCATGGCAGGTTAAAGGCCGTGTGAGCCAGATGAGTCCACGATTTTAATTTCTTTGTTTT
GTTATGCAACCCGAGAGGGGGCGCCAGCTGTTGGGGAGCCTGAACCTAAACCAATCCTCATCTCTGATGACGAACTAGAGGAAGCTG
TGACCGCATCCGATTTGCAGTCTTCTCCTCAGCCAGAAACAGGGTTTTCCCCAAGATCCCGCTTTTCACAACACTTGCCCGCGGTCA
GGAGCCTACTTCTTTAGGCTCCCTCTCCCTACAGGCTCACCTTAATGAATTGGAGAACATTGCAAAGTAAGTGATCTCCATCGTCGG
CCTTGGTTGGGGACTTATGCGAATTTCAGACAATCTCTCCTAGACCATGTGGCTGACGTTAGGCAGTTGGGAACTCTCGTCGTAGA
GTTTGATCAAGCTAAGTACGAGGAAGCCTTATCCTCAGGATCGCTTAGCCCCAAGGCTAAGCACGATGTCCGCGAGACCTCCAAGAA
GGTCAATTCTGTTGTCGAAGTGCCGAAGAAAGCCCTCTCCTTCGGCCAAGAACTCAAACTGGCTCTGCTGGCGGAAGATCCCACATC
CGCGTCAGCAAGACGTTCTTCAGGCCACAAACGGCCTCTGGAGGAAACGAGTTCCATAAGCGTCAACGACGCTGCTGCTAAGGCTTT
GAAACAAGCCAAGAAGAACGCCCGCTCGCCGACGGAGAAGATCCATACGACGAGCACATCTACGTGAAAGCTGACTGTTGCCCCAACG
CGAAGATCGCGTTTCTGAAAATCCAACAGAGCCTAGCGTTCCCAAAGGAGAACGCTCACTTCGCGGCAACGAGCCCAACTATGAACC
TCGCCTCATACAGCTGAAATGCGACCCTGAATAGCGCGTTGTTTCTTCAAAACGCAGCCCTCAGAGGAGGGCTGCCAAAACCAAACG
CGACCCCCAGGGGCGCGTTCCAATAAATCATGACTCTCGGGAGTCTGTTTCATCAATTAAACACGACCCTCAGGGGAGCGTCCAACA
TAAACACGACCCTCAGGGGAGCGTTCAACCTAAACGCGACCCTTAGGGGAGCGTTCAACCTAAACGCGACCCTCAGGGGAACGTTCA
ACCTAAACGCGACCCTCAGGGGAGCGTTCAACCTAAACGCGACCCTCAGGGGCGCGTTCAACCTAAACATGACCCTCATGGGTCAGT
TTCATCATTTAAACGTAGGCCTCGGCCTAATGTTTTCAAAGCTAAGCGCGACCCTCGCGTTATCCTTCAAGAACGCGATTTCCAAGA
GGTCCGCCAGGTTCAGAAGAATCAGCGTGGCTTCAAAATCCACGTTCAACGAGAACCAATTTCACCTACCCAAGGGCAGGGGGTTCA
ATCTCCGCCTCCAAGCCCAGGGAAAGTTTCCTCCCAAGTTTCCGACCTACGGGAATTGTTGTCAAGAGGAAAACCAACAATACAAGC
AGCTCACTCATGTCAATGTGAGAGACTGATTTCAGCAGTCCTGTCAGAATGCCCTTGTTGTGCACCCACACCACGACAGTCCGTATT
CGACAGGTTAACGAACGTCGTTAGGCCTGCCAAACGACAACGCCGCTACAGAAAGAAGACAGCTGAAGCGGAATACCCTCAGGTCAC
TATCAATATGATCGGCCGAGGGAAAGCTTCACATACTGACTCTGATGAGTCGCAAGAGAGTCATCCCCCGACTATCCGAGAAATTTG
TGACCAGTTCGAATGGATAGGAGCTATTCGTCCGGTTAACTATCAAAAGTTAGCCAAGGGCATTGCAACAAGTGATGAACATTCGGC

Fig. 13BO

AATAGCCGAATCTCAATCTTCAAGCTCTGTTGGAGCACGCGAGGTCTCCGCTTACATGTCAGGGAATCACGAAGACATCGCCAAAAG
AGTGGACGAACATCATGTCATGCTCCAGGCGCAACAAGAGACACTTCTCCAATTAAAGGATATGCTGGCTCAGCTTCTTGCTGAAAA
AGGCCACAAACCTGAATCTTCCCGGAGAACAACTTCAAAGGGAAAACAAAAAGTGCACGAACATTCAGATCGTGAGACTCACAACCT
GGGATCCTCTTCTGAAGGTGACAAGGAGATGGAGAAAGAACTGCACCCTCAATCTACTAAAGTGGATGACCTCGAGGCTCGCCTTAA
CGCAATCGCCAACCGAAGTGAGCTCCGCGAAGAGGGAGTAGTGCGGCCTTACCCTGCTGAGTGGGATACAGCTCCCTACCCACCGAA
ATTTAAGGCCCCTACCTTACAACCGTTTGATGGCACAGGATCGCCAAATCAGCACATCTACTACTTCAAGTCCCAAACAGGGGATGT
GGTAGCAAATGATGCCATCCTGACGCGCTTGTTTATCGGCACTCTTAAAGGTGTTGCTTTCGAATGGTTCATGAAACTGCCCGCTGG
ATCTATCCAGAAATGGGTAGACCTGGAAAGGCTATTCTTGGCCAGGTTCTTTGAGGATGATACGGAGGTCTCAGTCCCAACTCTTCT
CGCCACTAAGCAAAGGAAAGGAGAGTCCATCAAGGCCTATGTGGAGAGATTCCGCAGCATGGCATTACGATGCCCCTCAGGTATGAC
CCAATCAACTCTGGTTGAAACTTGCAGGCACAACCTGCAGACCCAGCTCCTTGCTCAAATGGGGGTGGCAGAATGTCGCTCCTGGAG
ACAACTAGTCTCACAAGGAGAACAAGCTGAAGAAATAGTGGCACGGCTCAAAGCCGAAGAAATGCCACAACCCAAGCCGCAGCAGCA
AAATCAGCAACGCAACCAGAACAACGCCCAACGGTCTAAGGGGAAGGAGACCTTGGCGGCCGACTACACGCGAGTACCACCACCGAA
TAAGCAAGGCAAGGCGCCAAATCAGCAAAGAACGCCCAAGCAGTATTCATTCAAAGAAGAGCATGTGGATACCTTATTCCAATTGCT
TCGAAAGAACAACAAGCTGCAATTGCCTGAGATCAGGAAGCCGGATGAAGCAGGGAAAGTGGATGACCCCAACTATTGTCGTTATCA
CAGATTCCTTGGACATCCTACCAAAAAGTGCTATGTCTTCAAAGACATCTTGCAGAATTTGGTGAATGCTAATGTACTCACCTTGAA
GCCAGAGTAGAAGACCGTATCAACTAATATGATAGCGGTCCAATTCGGTGACTTTCCCCCAGTGGTAACAGCGAACGGCGTCATCCC
CATTCGCAAGGCGAGAAATGCACCTGAAGAATGTTGACCCGCATAGTCAGAAAGACAGGGGGTTAGTGCCTCTCACTACCCAAAAACG
GGAAATCATGTGGGTCCATCCTGATCTGCTAAGAGATCAACAATGGACAAGCACCCCGTCCAAAAAGAAGGGAGGCAAGGCTAAGTC
TTCCAACATGATTAGCCCCTCCATTACTGAAAATAATGAACCTCAGACCTCTTACTGATTCAGAAGAAGAGAGGATTGTTCTAGCAG
CATACCCAGAAGGCAATCCTGGCACTCGGTCAGGAAAAGCTTACTTGAGGGATTACGGCCAGAATGCTCCAGAAGTTGAAGAGCAGC
CCCAAGACGCTGGGGGTTCTGCCCCAAAAAAGCCAGTGGACAAAGGAAAACAGAAGGAGCTCCGATTCAACAGAAATCTCCACCAAG
AATCTGGAGAGTCGAGTGCTCCCTTCCAATTCAACGTCATGGCGCAGCTGGCCAACATACCGGCCAGAATTACGCTATATGAGCTCC
TAAGGTTATCCAAATCCACCAAGGAAGCTCTAATTAAACCTTTGAAGAATACGGAGAGCTTCATTACTCAAGTAACTCCGACTCCCG
AAGCCTTTGAAGATCAACTTTGTCTGCAATGCCTACAAGCAGCGCGAAGTCTACCATGCATATCATTCACGCAGGAAGACATGCAGG
TCAAACACGAACATGACCGACCACTATACTACACAGGCTATATTGGATCCTCTGAAATCAGTCGTGTTCAGGTTGACCCAGGCTCAG
CGCTCAGCATCATGCCTTACAGGGTCATGCAGGTCTTAGGGATTCCTATGCACCGACTGCACACCACCCAGACTACTATCTTCGGGT
TCAATGCAAACAGTACCCGACCCCTGGGAAAGATCAAGCTCAGATGCCAGATTGGAGATCTTAAGTCTGAAGTAGCATGCTACATCA
TAGATGCAGACACGTCCTACAATCTTTTGCTAGGACGACCATGGATACATGCAAACCGCATTGTCCCATCTACTCTGCACCAGGTCA
TGAAGTACGCCAATGACGAGGCGAAGTCCGAACCTTGATTGCAGAAAAATACCCCTTCCGAGGCGTGGAAAACTTCCATACCGACT
CCGTCTTCTATTCGGAATCCCAAGAGAAAGAAGATGTAGACAGCGGTAATGAGGCTGACATTGAGCCAGATCCCGATGAAGATTGTC
CTTGGGAATTAAATTTTGATGTAATGGGTCAGGGTGAGAGTAATAATGATGTACCGAGTGAGGCGAGTGGTGCATTAATAAAGATT
TCATTTTAGCGTACTTGTCTGATGTCTCTCCTGAAAATGAACAAATAGAGAATAATTCTAGTGCAGGTACCAACCCATGGCACATAC
TGTGCACAGAGGCGTCGCTTACCTTGCCAATTCAGTCATCCTTCGCTTCAGATGAAGAAGTGGAGGACGCACAGAAGGCTTTCTTCA
AAGTCTCATCCAAAAGGAAAGGCAAAAGCCGATCTGTTTTGGTAAGGTCAAACCCGAACCACTCCGACGGGAAGCTCGGAAGAAG
ATGATGGAGTTCCCCAATTCCATTACCATGAACCCAATTCTATATACTTAATGAAACTAATGGGTATAATTTTAATGAGAAACAGG
GCCTTAACTTCGGGAAAGGAAGCCGAACGCCGATCCGAATGTCTCTCACTCCTGAAGGAAAACCTCCGGACTATTATCAAAAAACCG
GAAGAGGCATGGGTTACGTTACACCTCCCCCCGCTTCGGAAAACGAAATCAGTAATTACCTGCGTCACGACCATTCATCTGGAACAT
CTTCATACGAGTCCGACGTCAGTGTTGGACCTTTCTTTAAAAGCTTGACTGTGAACATGGTTTCAACTAGTCATCCAGATGAAGACG
CATGGGGTGACGAGGAGTTGATGGAATCGACCAATGATCCTTGGATCAAACGTCTCAATATCTTGTGGGATATGCGATTCGAACAA
CGCGAACCACCCACTGAAGATAAAGTGATCCAGGTCAACATGGGAGATGAACATGATCCTAAGCCCATATTCATAGCTGAAGACTTG
TCATCATCCGAAAAAGAGGACCTTATATCTCTCATCCGAGAATATATAGATGTCTTCGCTTGGAATTATGAAGATATGCCTGGCCTT
GACCCGAAGGTTGCCATGCACCGTCTCAACATTGATCCGGACCCAAAACCCGTTAAACAACAACAACGTAGGTTTCGTCCAGAGATC
ATGGAATCAATCGAGTCAGAAGTTAAAAGCTTATAGACTCAGGTTTTGTTAGAGAAGAACAACACCCAGACTGGTGGCCAACATT
GTTCCAGTTCCCAAAAAGAATGGTAAGGTCCGGATATGCATCGATTTCCGCGATCTCAATGCCGCTTGTCCGAAAGACGAATTCCCG
CTTCCTATCACGGATGTTATGATTGACAACACCTGCGGATATGAAAGGATGTCTTTCATGGACGGATTCTCCGGGTACAATCAGATC
AAGATGCACCCGGACGACAAAAAGCATACTGCTTTTAGAACACCGCTGGGGTATATTGCTACACAGTGATGCCCTTCGGCCTGAAG
AATGCAGGTGCAACTTATCAACGTGCAATGAACACAATCTTTCACGAACACCTACGAAAGAAGATCGAGTGCTACGTTGATAACATA
GCGGTAAAGAGCCAATGCAAAGACGATCATCTTGCAGATCTGAAGACAATGTTCGAAATCATGCGAGCACATCAGCTGAAGATGAAT
CCGACAAAATCATTTCTCGGAGTTTCAAGCGGAAAATTCCTAGGATTTATCGTTACTTCCAAGGGGATCTCCCTTGATCCAGAGAAA
GTGCGTGCCATCCAAGACATGCCACCTCCGAAGAATCTCAAAGAGCTCAGAGGTTTGCAAGGCAGACTGGCCTACATTCGAAGATTC
ATCTCAAATCTTTCAGGGCGTTGCCAACCTTTCTCTAAACTCATGAAGAAAGGAATATCCTTTGTTTGGGATGCAGAGTGTCAAAGA
GCATTCAAGGAGATTAAGAGATATCTAACTCAACCGCCAGTTCTCGTGGCCCCGATATCAGGAAAACCATTCCTGTTATATGTGAGG
GCCATGGATCATTCTCTTGGTGCTTTGTTGGCCCAAAACAATGATCAAGGTCAAGAGCAAGCCATCTATTACCTGAGCAGGACTATG
ATGGGAGCCGAACATCGGTACAATCCGGTCGAAAAAGAGTGTCTCGCCTTGGTATTCGCAATCCAAAAGATGCGACATTACCTAGTT
GGACAGACCATTCAGGTCATCTCTAAGGTAAATCCTTTGAGAGTTCTGATGACAAAACCATCATCTCTAAATTGCCGGCTTGCAAAA
TGGCCATTCTCTTGTCGCAATACGACATGCAGTTCATGCCTCAAAAGGCGGTCAAGGGCCAAGCACTGGCAGACTTCTTAGCCGAT
CATCCAGTATCAGGAGCATCTAAGTTGTACGAGGAATTACCTGACGAGGTTGCTGAAGCTTGCGCTACCCAAGAAGCTACGCAAGTG
TGGAAGCTATTCTTCGACGGTGCATCCAGAGCAAATCCTCATGGAGCAATCACTGCGGGAGTAGGAGTAGTGTTAATCTCTCCGAAC
GGCCACCTAATCCCAAGGGGATTCTCTTTAATCGAACCATGCACCAACAATGTAGCCGAGTATAATGCTCTGCTATTAGGAATGCAA
TGTGCTGAAGAACTTAATGTTCAGCACCTTGAGGCTTACGGTGATTCTCAGCTCATCGTTAATCAAGTCCGAGGAGAGTACGAAGTA

Fig. 13BP

CGTCATGAGGATTTGATTCCGTATTACTTCGCGGTGCTAGAGCAAGCTCAAAAGTTTGAAGGCTTCTTTATTGAATATGTGCCAAGA
GCTCAGAATGCATATGCTGATGCCTTAGCCTCTTTGGCAACTTCACTAGCCTTGCCACCAGGAGTGGAAGCGACGATCCCGGTCATG
GGACGTAAGCTGTGCTTTTCCAAGATCTCCATAGAGGAAAACCCAGACGAGATGACGTCGGGAGAAGTCTGTACGGCATTTATGGAA
TTCGAATCTAGGGATTGGCGATTCCCATACATCGACTATGCCCTATATGGAATTCTACCCGATGACCCTAAGGAAGCGGCTGCCATC
AAACGGAAGGCCCTCCAATTCTATTATGATGCAGTTTCTCAAGTCTTGTATCGTAAATCACATGATGGAATCTTACTTCGATGCCTT
TCTCGGAAGGAAGCGAAAGAGGCCCTCAAGGAAGCTCACGGCGGAATGTGCGGAGCTCATCAACCTGGAGCTAAATTAGGAGATCGA
CTCCGACGAATCGGCTATTATTGGCCGAGGATGTTTTCAGACGCGGTTGACTACGCTAAACGTTGTCACGCATGCCAAATTCATGGA
GATTTTATTCACCAAGCACCGGGGAACTTACACCCCACATCGGCGACTTGGCCATTCGAAATGTGGGCATGGATATCGTCGGACCG
ATCTCCCCTCCGACGTCCAAAGGACACCGGTTCATTCTAGCCGTGACCGACTATTTCTCCAAGTGGGCGGAGGCAATCCCGTTAAAA
GAAGTCAAGACTTCAAACGTGATCAAGTTCATCAAACATCACGTCATCTATCGTTTTGGAGTCCCAAGACGAATAGTTCACGACAAC
GGACACAATTCGTCAGCTTTGGGTTTCAGAGATTTTGTGATAAATTCAGAATCCAAAGTGTTGCATCTACGGCGTATTACCCACCA
GCAAATGGTCTTGCAGAAGCTTTCAACAAAACCATAGTGAAGCTTCTCAAAAAGTTTGTTTCCAAGAGCCGGCGCGATTGGGATGAA
AGACTCGGTGAATGCCTGTGGGCTTACCGCACAACAGTGAGGACCCCTACAAGAGCTACACCATTCTCTTTGGTATATGGCTGCGAG
GCTGTACTGCCATTGGAAATTCAGATCCCTTCTCTGAGAGTTGCTATCACAACTGGACTAACAGAAGAAGAAAAACATCAACGACGT
CTGCAAGAACTTGAAGCTCTAGATGACAAACGACTTCAAGCGCAGCAACAGATTGAGCTGTATCAAGCCCGTATTTCCAAGGCCTAC
AACAAAAAGGTCAAGGAACGGATTTTCAGGAAAGGCGATCTAGTTTTGGCCAACAGACGACCCATGGTAATGACCCACAAAACCAAA
GGCAAGTTCAATCCCAAATGGCAGGGCCCTTCGTAATAGAATCAGTCTATTCGAATGGAGCTTATCGTCTCATCAATCAAAAAGGA
GATAGGCTCATGATGCCAATCAATGGGAAGTTCCTTAAGAGATACTTCCCATAAATCATGTAGCCCCTGAACCCCAGCTAAATCAG
GCTGGGGGTTGCCTATTTATAATGTAACCCTGTCTTGTATTTCGTCATGTTAACATTACACCTCTGACGATTGAAATTTGCTAGAAT
CGGTATAATAAAGAAAATTTCAATTTCATGCCAGGTTAACACTATACTTATGGCATTTGCTTTACTTTTCATTGTCCTGAACCAGAT
TTCAACAAAAGAGATGATGAGAGCCAAAATGATATCATTTTCATTCAATATTTTTGATTTGAATACAAAATGAATCGAAACGAAAAT
GATACAAAATTATTCCTAGCTAAAAAGCAATCCAAGTCCTAAACATCGGAGCTCATCAGTCTAAAAGACTTGAGTTTAGCTTTCAGC
GCCAATATTTTCTCCTCACGAGCCTTTTTGACTTCCTCTGTTATCTTGCTCTTGAGCTCCTCTTCATTTGGCGCTGCTTCTCCAATC
TCCCGCCTAACTTTGTCAGCAGCAACAAGCTCATCACAATAGCCCTTGAAAAGCCCGTCACAATAAGCAATTAACCCTTTTATGACT
TCCATGTCGCCCGCTAATCGAGCAGTTATCTGAGCTTGCTCGATACCAGCACGGGTAAGCTCAATCGCAGTATCCCGAATACCTGCA
GCAAAAGTGCCCAAGTCCACTTGCACTTGAAGATGTTCCCCGCGCAGGCGAGTAATACGAGAATCTGCTTCGTTTAGACTCTTCTGA
AGAGCTTCTTGCTGCTGTACCTTCAAGGCTCTGGCCTGAGAAAGAGCCCGATCCACTTCTGGTTCGATGGCATCGCGTTGTAGCATT
GAAAGGAATTCCAATTCGTATTCCAGAACAATAATGCTCTCGCGACAATGTTCAGTCCACGATGAAAAGAAAGGGCAGAAGCCGATC
TGTTTTGGTAAAGTCAAACCCGAACAACTCAAACGAGCAAGTTCAGAGGAAGACGACGGAGTTCCCCAATTCCATTACCATGAACCC
AATTCTATATACTTAATGAAACGAATGGGGTATAATTTTAATGAGAAACAGGGTCTGAACTTCGGGAAGGGCAGGCGAACCCCAGTC
CGAATGTCTCTAGCCCCTGAAGGAAAACCTCAGGATTATTACAATAAAACCGGAAGAGGTTTAGCTTAGGAAAACGAAATCAGTAAT
TACTTACGTCATGACCAGTCATCCGGAATATCGTCATACGAGTCCGACGTCAGCATTGGACCCTTCTTTAAAAACTTGACTGTGAAC
ATGGTTTCAACAAGTCATCCAGACGAAGACGCAGGGGGTGACGAGGAATTATTGGAATCGACTGATGATCCTTGGATCAAGCGTCTC
AATATCCTGTGGGATATGCGCTTCGAACAACGCGAACCACCCACTGAAGATAAAGTGATCCAAGTCAACATGGGAGATGAGTCTGAC
CCCAAGCCCATTTTTATAGCCGAAGACCTATCATCCACCGAGAAGGAAGACCTTATATCTCTCATCCGAGAATATATAAAGATAAAG
TGATCCAGGTCAACATGGGAGATGAATCTGATCCCAAGCCTATCTTTATAGCTGAAGACCTATCATCATCCGAGAAGGAAGACCTTA
TATCTCTCATCCGAGAATATATAGACGTCTTCGCTTGGAACTATGAAGATATGTCTGGCATTGACCCGAAGGTTGCCATGCACCGTC
TCAATATTGATCCGGACGCAAAACCCGTTAAACAACAACAACGCAGGTTTCGTCCAGAGATCATGGAATCAATTGAGTCAGAAGTTA
AAAAGCTTATAGACTCAGGTTTTGTTAGGGAAGAACAACACCCAGACTGGGTGGCCAACATTGTCCCAGTTCCCAAGAAGAACGGTA
AGGTCCGGATATGCATTGATTTCCGCGATCTTAACGCAGCCTGTCCAAAAGACGAGTTTCCTCTTCCTATCACTGATGTCATGATCG
ACAATACTTGCGGATATGAAAGGATGTCTTTTATGGACGGATTCTCCGGGTATAATCAGATCAAGATGCACCCGGACGACGAAAAGC
ATACTGCTTTTAGAACACCGCTGGGGGTATATTGTTACACAGTGATGCCCTTCGGCCTGAAGAATGCAGGTGCAACTTATCAACGTG
CAATGAACACAATCTTTCACGAACACCTCCGAAAGAAGATCGAATGCTACGTTGATGATATAGCGGTAAAGAGCCAATGTAAAGGTG
ATCATCTTACAGATCTGAAGATAATGTTCGAGATCATGCGAGCACATCAGCTGAAGATGAACCCGACAAAATCATTCCTCGGAGTCT
CAAGTGGAAAATTCCTAGGATTTATCGTTACTTCCAGGGGAATCTCTCTTGATCCAGAGAAAGTGCGCGCCATCCAAGACATGCCAC
CTCCGAAGAATCTCAAAGAGCTCAGAGGTTTGCAAGGTAGACTGGCCTACATTCGAAGATTTATATCAAATCTGTCAGGGCGCTGCC
AACCTTTCTCTAAGCTTATGAAGAAAGGAATATCCTTTGTTTGGGATGCGGAATGTCAAAGAGCATTCGAGGAGATTAAGAAATATC
TAACTCAACCGCCAGTTCTCGTGGCCCCGATATCAGGAAAACCATTCCTGTTATATGTGAGGGCCATGGATCATTCTCTTAGTGCTT
TGTTAGCCCAGAACAATGATCAAGGTCAAGAACAAGCCATCTATTACCTGAGCAGGATTATGATGGGAGCCGAACATCGGTACAATC
CGGTCGAAAAGAAATGTCTCGCCTTGGTATTCGCCATTCAAAAGATACGACATTACCTAGTTGGACAGACAATTCAGGTCATCTCTA
AGGTGAATCCCTTAAGAGTGCTGATGACGAAACCAGCATCTCTGAATTGCCGGCTTGCAAAATGGGCCATTCTCTTGTCGCAGTACG
ACATGCAGTTCATGCCCCAAAAGGCGGTCAAGGACCAAGCACTGGCAGACTTCTTAGCCGATCATCCAGTATCAGGAGCATCTAAGT
TGTACGAGGAATTACCTGACGAGGTTGCTGAAGCTTGCGCTACCCAAGAAGCTACGCAAGTGTGGAAGCTATTCTTCGACGGTGCAT
CCAGAGCAAAAGTAGTATTAATCTCTCCGAACGGCCATGTAATTCCCAGAGGATTCTCCTTAATCGAACCTTGCACCAATAATGTAG
CCGAGTATAATGCTCTGCTAATGGGAATGCAATTATCTGAAGAACTCAATATTCAGCATCTTGAGGCCTACGGTGACTCTCAACTCA
TTGTTAACCAAGTCCGGGGGGAATACGAAGTACGTCACGAGGATCTAATCCCGTATTACTTCGCGGTGCTAAAGCAAGCTCAAAAGT
TCAAAGGTTTCTTTATCGAATATATACCACGAGCTCAGAATGCGTATGCAGATGCTTTAGCCTCTTTGGCAACTTCATTAGCATTGC
CACCGGGGGTTGAAACAACGATTCCAGTCGCGGATGGAAATTATGCTCTTCCAAGATCCCCATGAAGGAAAACCCAGACGAGACGA
CGTCAGAAGAAGTCTGTACAACTTCTATGCAGTTTGAATCCAGAGATTGGCGATTCCCGTATATCGACTATGCCGTATGGAATTCTG
CCAGATGACCCTAAAGAAGCGGCCTCTATCAAACGAAAGGCCCTCCGATTTTATTATGATGCAGTCTCTCAAGTCCTGTATCGTAAA

Fig. 13BQ

TCGCATGATGGAATTTTGCTTCGATGTCTCTCCCGGAAAGAAGCAAAAGAGGCCCTCAAGGAAGCTCATGGCGTAAAGTGCGGAGCT
CATCAGCCTGGAGCTAAATTAGGAGATCGACTCCGACGAATCGGCTATTATTGGCCGATCCGACGCATCGGCTATTATTGGCCGAAG
ATGTTTTCAGACGCGGTTGATTACGCTAAACGTTGTCACGCGTGCCAAATTCATGGAGACTTCATCCACCAAGCGCCAGGGAACTTA
CACCCCACATCAGCAACTTGGCCATTCGAAATGTGGGCTATGGATATCGTCGGCCCGATTTCCCCTCCGACGTCCAAGGGACACCGG
TTCATTTTAGCCGTAACCGACTATTTCTCCAAATGGGCGGAGGCAATCCCATTGAAAGAAGTCAAGACTTCAAATGTAATCAAGTTC
ATCAGGCATCACGTCGTCTACCGTTTTGGAGTCCCGAGGCGAATAGTTCACGACAACGGGACACAATTCGTCAGCTTTGGGTTTTAG
AGATTCTGTGACAAATTTAGAATCCAAAGTGTTGCATCCACGGCATATTATCCACCAGCGAATGGTCTTGCAGAAGCTTTTAACAAA
ACCATAGTGAAGCTTCTCAAAAAGTTTGTTTCTAAAAGCCGGCGCGATTGGGATGAAAGACTGGGTGAATGTCTTTGGGCTTACCGC
ACTACGGTAAGGACCTCTACAAGAGCCACAACTTTTTCTTTGGTATACGGCGGTGAAGCTGTATTGCCATTGGAAATCCAGATCCCT
TCTCTGAGAATCGCTATCACAACTGGACTAACAGAAGAAGAAAAGCATCAACGACGTCTGCAAGAACTTGAAGCCTTAGACGACAAG
CGACTTCAAGCTCAACAACAGATCGAGTTATACCAAGCCCGTATCTCTAAAGCCTATAACAGAAAAGGTTAAGGAACGGATTTTCAAG
AAAGGCGATTTAGTTTTAGCCAACAGACGACCCATGGTGATGACACACAAAACCAAAGGGAAGTTCAATCCTAAATGGGAAGGGCCC
TTCGTAATAGAATCAGTCTATTCGAACGGAGCATATCGCCTCATCAACCAAGAAGGAGATAGGCTCATGATGCCAATTAATGGGAAG
TTCCTTAAGAGATATTTCCCGTAAATCATGTAGCCCCCTAAACCCCAACCAAATCAGGCTGGGGGTTGCCTATTCATAGTGTAATTC
TATCTTGTATTTCGTCATGTTAACACTACACCTCTGACGATTGTAATTTGATGGAATTATTCTAAATAAATAATAAAAGGGGATTTC
GATAACATTTGCATTATTTTCTATTGTCTTGAACCAGATTTCAACAAAAAGAGACGATAAAGAGCAAAAGTGATATCATTTTCATTC
GATGTGGTTAATCCAAACACAAAATGAAAAAGATACAAAATTCCTTAATCAAAAACAGGTCAAGAGCTAAACATCAGGCTTCATTAA
CTTGAGGGTTTTTAGCCTAGACTTGAAGGCAGAGAGTTTCTCCCGGTGAGCCGCTCGAACTTGTTCCTCGATCTCCTTTCTGAGTTC
TGCTTCAATAGCAAGAGTAGCAACAATGTCCTTACGAGTCTGCTCAGCTGCGTGGAGTGTACGGCAAAATTTCGTATAAATTTGGCC
ACTTTTATGCTCAAGCTCTTTTCTGACATCCTCATAGTGGGCCAATTGAGCTTTCTTCTGGTCCAACTCGGCCTCTAATCGAGCGAT
AGTCTCTTCAATATCACGAATATCAGAAGCAACACGTTTGATTTTACCATATGCTTTAGAGTGTCGCTTCCTTAAAGTTGATATACG
GGCTATTTTATCAGATAGTTCCTTGCGAAGATTCCCTGGGTGATGCGCTCTCGAGATTATCGCCAAGGAAAGAGCCGGCTCCACTTC
AGAATCTAAATTGGCGCGCTGTAACTCCCTGAAAGCTGTCAATTCTGCCATCAAAAGAGTGATCCCACCCTGGCAGTGCTCAGTCCA
GGATGCATCCCCTTTGGCCTTGATGTCGTCCAAACATTGGCTCAAGATGGATTTACAGTCTTCAAGAGAAGCCCCCTCAACACTGAT
CATACCAATAATTGTTTGCATCCAACGTTCCAGTTCATCAATTGATTTCTTCAGAGCTCCTGAGCGTGGAGGAGGAAGAGTTGGATA
GATTGGATCCCTATGATCATCCTGAACAGGTGTTGGAGCAACTTCAGAAGAAGGACCCTCTTCAGCCCCATCGTCTTCAGGAACTGA
GGGGATCGATTGAGGCATTTCGTCCTCTCCCGTCAGTAGAACGCTCAACGAGCGCAGACTTCATCGCATCCCCCATTATTTTGGCCCT
CTTGGAATTCTTGGCCATGACAGGTATCCGCTTACGGATTCTCCTGTCATACTCACCTTGCTCAGCAGCAGAAAGAGCTTCCTTACC
CGATCTTAAAGAACGAGGTGTAGGAACGGGCTCTTCTCCAGGGATCTCCTCAGTGGTCTTTTCTTCAGGAGAATCATCAATTGGCTT
TCCCTCTTCAATTCCCGTAGGAACCTCTTCTTCAGAAGGTTCTACGGTGGACAAGTCTTTAGGAGCTTCAACGGCTCCGGTCGCTTC
CTGTTCACAAGATACGTATTCTTCCATCCCTGGTAGACGAGTACTCGCAGAACCGCTCCGTGAACGATACAATTCCCGAATCTCGTT
TATACATGAAGTATAAACGTCATACTCCGGAATCTGAGAAGCTTCGGCAAACCACTGGCGGAAATCCATAACAGCAGAGCAGCCGG
TGATGAATGGGCTAAAGTGAATTGCGCATGGGTTCCCCCGGCAGAGAAAAAGTACCATGCGCGAGCTCCTTCGCATAAATTCCCAAT
CTGAGCTAACGCCGGGTTAGGATTGCCAACATAGAGTTACAGCAGAAAACCCGGTAATTATCTTCCCGGGATAGAAGCTGTCGAGCC
CTGACTATATAAGAACTAGTCCACGTGGCCGACTCCAACCTTTGTACGAAGGGAGTATAAGCATCATCCCCTTCATGCACTCCCGTC
ATCAAGGAAGGGCAATGCAACACGAACCAGGCCACTAAATATGTATATGGCATTGGTACACGTGGTTGAGGAGCCTTCCCAGCTTTC
TTCTTAGTAGCTTTGACTCCCGAAGCACTGAGAAGTTCTGAAGTCAATACCCTCAGGCCGTTCTGGATACAGCCAACCATAGCAGTA
AGGAGACTCACAGGTCTCCCATGCGCTAGGAAAACAGCTGGGTACACAACCTCAGCCAATATTGATTCTATTGGTCTTGACGGTACC
ACACACCGCTTCAACCAAATCATGAAGAAGCCTGCAACTAGAGACGTGTCAGAGATAGGAACTGTGGCTTGGTAGTGAAAACTTTCA
AACTCGGCACCAGCTTCAAAATCATCCTCTGCATGCTCTGTCTTATAGGTAGCACTGGAAGCTGTAATTCGAGCTTTGGCATCCTTA
CGAATCTTTCCGATTTAAGTTTTGAAAGAGGTAGTCTGCCCATGTGGTATGCATAATACCCCCTCCACGCATCCCAAAGACTTGGGC
ACATATGTGGAAGTGGCACATCAATTCCCAAAAAGTAGCATAAATTTCCGGGTGTGCCACCTTCAGTAAGGAAAGCTCCTCGGTGGT
AGGGATAAACCCCTCGTAGGGCGTTTTTCCAAGTGACAGCCCCGACACTGCCTGCATTTCATGAAGAGCAAAACCTAACTCTCCAGC
AGGCGTGAAGAATGTGCAGCTGTCAGGATTATATTTCTCCAACATACCGAAGAAGTTCTGAAGGCTCTGCACGACTCCCCGTCGTGT
AGCTAACACAGGAACTGTGAGACCCGATCGGGTCCACCAACCTCCTTCTAGAGAACAGACCCATCCAGGGGACCTGAACGTCTGGGT
AGAGAATTCACCCTGAGTTGCAAGGAATTGGCGGATAAAAATGTTCGCTGGACGTGGCACCTCCGAAACCAGCTCTTTCTTCTCAAA
CAAACCAGGTTTTAACCCCTTGAGTTGTTCCCCGATTTCTGTACGAGCCCGTCGACCAAATCCAAGCGACACGTTCTCCTTCTCCTT
TACTATGTCGAAGGTCAAACCCCGACGGCAGCTCATATTCAAAAAGTAGGAGAGAGGGTACATCCTCTTCATGTTTGGGAGAAATAA
AAAGCGATTATCAGTTCTCTGCAGCAGCTTCGAATCTTCTACATATGTGAGATGGTCATCGACTGGTATGCGATCTCCAAATATGAA
TGCTGGTTTGGGAAACTGGGCATGACCAACAGGGTCTCCAAGTCCAAGTCAGTTATCAAAATCCTGAGAGTAGAGCATTGAGGGAA
TTTAATCATTTCCGCTCTTTCCGAATCAAGAAAAGTACACAATGGAATCCTGTTCTGAAGACTGAATAATTCATTCGGTCAGGTCC
ACCAATATATCCGAAATGGTGCTCTTGTGAAAGCGGCACGTTTGGGAGAAGCACTGCACCTCGTGTCAGAAATCTCCAACGCGAAGG
TCGAACCTCGTGTCAGAAATCTCCAACGCGAAGGTCGAACCTCGCGTCAGAAGTCTCAAACGCGAAGGTCAACCTCGCGTTGAAAAA
CTTGAACGCGAGGGTCGAGACCCACATGGGATCCCAACCCCGCGTTTTCATTGAGTTGAAACGAGTCATCTTCCTCGTTATCAAGAA
CCCATCTAGGGTTTTCAAAGAACTTGCCAAGGCAAGTTATTTCGGTCAGCACTCACCACGACAGGAGGCCCCTGCGGCGGCGATGT
CGATGGCAAGGTTCCTGCATGGACAAGAGCACCCCCGGCGTTCTCAGCCGACGGCATGTCGGAAGTTGCTCCAGCGACCTTCTTGGA
GTTCGAACCCGTCCTCCGAGGCGCCATTGATGCAGTCGATCGAAAGAAACTCCTTTGAACGAGGGAGACGAAGCTTGTCGGAGATCT
CGCCATAGTCAAACGAGAGTTCTCGTTCTTGGAAATAGCCGAAAGTTTTGAAAGTCAAGTGACTTTTGATGTGACCATTCAGGTCTA
TTTATAACAGCCGCCAAGCTGTTAAGATGGTACAGGATTCTAGGAGTGAATCCCAACCATCTTCAAAACGCGAAGCTCACTATCGCG
TTCAATTTCCCGAGTGCAAAGCTCAGGCTAGCGCCACGAAGGCCCGAACCTCGCGTTCTGAATCCCAAACGCGAAGGTCACTTCAGC

Fig. 13BR

GTTATAATTCTTCTAAATGAAGAATCTACATTTGTGTCATCAAACACAACACTTATCCCTCAAAGTCATGAGCCCTCTTAACAGAGA
GTTAGTCAAAACCTCTGTATCTCATCAGCAGAATCTAAATTCTCATCGGGCTAATATTGCACCCCAGAATCCACTTATCAATTCTCA
TTAATAGAATGATAAGTCTCCAACTCATTGTCAATTTATTAGCTCTCCTCAGCAGAGCAATAAATAACCTGCTTCCAGCGGGTTAAC
AAAATTCCCCAAAACCTTGTCCAAATCACAAGTATCACAATTCATCGCTCCGATGGTAAAACACTTAGCAGTTCTCCCCAGTGAGAT
GCTATAATATCCTTCCCCCACAGTTGTCACGTTAAAATTGCACCTCTGACAAAATCAACTTATCGATTCTCATCAATAGAGCGATAA
GTCCTCAAAATTGCCCTGATCGCAATATTCCAGTTGTCACGTTAAAATCACACCTCTGACAAAATCAACTTATCGATTCTCATCAAT
AGAGCGATAAGTCCTCAAAATTGCCCTGATCGTAATATCCCAGTTGTCACGTTAAGATTACACCTCTGACAATATCAATAATCCCCA
TGCCAAGTTGAAACTATACCTCTGGTACTTATAGATTTCTTTCAGTGTTCAAAGCAAGAAATAACATAGGAAGAAATCTACTAGTCA
ACCCCATTATGGGAATATTCATCCTCAGCAGTTTAAAACTTTCTAGAGTTATTTTAAACGATAATAAAGAGAGTTTTCTGCACCAGA
ACCATTGTGGAGATCTATTCTAAGTCAGGAATACATCCCAGGCATTTCTCATGACTTGTATTTAAAATTAAAACATAATAAATGCAA
GAAACAATGAGAAGTCAATATCACTTTTTATTCAGAAACCAAAAAGAAGTGATACAAAGCTGTTCTTAAGCAAAAGAATAGTACGAG
TTCAAGTCAAAAGAAGCAAGTTGAGCTTTGGCATCAGAGAGCTTCTCCTCATGATTGGCTCGCACAAAGGCTTCAGCTTTTTTCCGC
AGCTCATCCTCACTGGGTGCCACTTCAGCGGCTGCCTCCTTCTTCGGTCTTTCAAGAGCCTGAGCTTCCTTACGGTACTTCAAAAGA
GTGTCTGCATTCTTGGCCCCAAGGGTGTTAACAACGGCTTCTTCTCGAGAAAGCTCGGCCTTCAACCTTAACACCTCCGCCTCAGCT
TCGACAAGTTTCGTGCAAATGAGGTCCAAAGAAGCAGTTGAGAGTTCCAGTTCTTTTTGTCTCAGATCGCTCTGTTCCCGCAACTGC
GTAACTTGAAGCTCTTTTTCAGCCAGGCCTCGCTCAATTGCCTCACGGCGAGTCACTTCCTCAACCTGGAAGTCAGCAAAAGTAGAC
ACGATCTGTGTATGAATGTCTTCATGGCTGTGGCTTCCAAATGTTTGACTCGGGCTTCTAAGTGGGAAATGGCTTCCGAACAACGT
TCAAAGCAATGAGCATTGCCCACACTTTTGACCCCATTTAAGCCTGCTTCTAAAAGACACTTAAAGGACTCAAAGCGGCCTCGACCA
GCTGTGACAACCTCAATCACCTTCCGCACGAGACTGTTTAAGTAGCTCAAGGACATATGGAGGAAGTCAGGAGCGTCCGTTGGACTA
GAAAAAGCAATGGAAGATGACTCTACAACCCCAGAAGTTGACATGCTAAAATATGGATTGGCAAGTGATTTGGGTGTAGAAGTCGCG
GAGCCAACTAAAATATTCAATTGCGAAGCCCTTGAAGTCAAGGCCATCATTGCCCTCGCCGGAGATTCGCTTGGTCCGGCCTCTGTG
GGCGCAAGCGAGATCTTCATCAATGCTGAAGATGAAGCAGCTACGGTGGATGAGGCAGGCAGGGGCTGCTCTTGCATAGAAGCTGAC
GCCTGCACGAGCTGCTGTTCCCGGTGGAGGAGTTGCAGTAGTAGTTTCAGGCAACGCTAAATGTTGCTCTTCTAAAGGAGCCGACACC
TGAGCAGGTTCTGGCTCGGAAGCAGCAGCAGCAGTAGTCCTTGGAGAAGGTGAACCTGCACGAAAAAAATGGTCGGAACGTGGAGAAA
GCATGTGGAAGAAGTCGAAACAAACCAAGCTTACCGCTAAGATAGAAAGGAGTATAACCAGATGCTTTATCGGATGGCACCTTGGGA
GCGTCATCATCAAAAGTGGTGACGTCATCTATGGAATCATGCTCTTCGTCATCTTCACCACCACCTGACATGTTGCCAACGTCAGCG
TCCTCATCATCTCTATCTTCGTCAGCTGCACCACCAATCGAGGAGTCTTCATAATCAACTCGCTCCTCATCATCCCGGGTAGCTGAG
GGCTCAGGGAGACTTGCACCTGCAGCTGGTCTTTTCATAGGTCCCGTTGTAGGACTAGGCATTAAATCACCAGCTTGTGACATTAAT
GCTGAAGGAGAAGGAGATGGATTATCTTCAAGACCCCCTGGTTCCAATGCAGGAGACCTAGGAAGATCCATCACCGGAGCAGACTCT
GCATCTGCAGCCATTAATTCATCTTCTTCGTCCTCAGGAGGATGATAAGAAGAAACTTCGCCCGACAGAGCTGGGCCATGAGAACGA
AGTCCCGCTCTGTGTGGCAGGCCAGCCACAGATGATTCCTGTGGTTCGTCATCTTCAGCTGCTTTGATGGCATCAGCCATAAACTTG
GACTTTTGTTGGCCTTTGGGGGGAGAATCCACCAGCAGTTTCTGACGGATCTGCTTATCATACTGGCCGGCTTCATCAGCAGAAAGT
TTTCTTTTCCCCGCTGCTCTTGTCACGGGAGGATCAACCACTCGTTGCTCTTCCCCTAGAGCAGGCTCAGCTGTCTGTTCCTCTTCT
TGTCTAGCAGATTGATTCTCGATGGACAGAAACTCATCGATCCCTTTCAAGCGGGATGTCTTGGACCCCTTCCTTAAATTATACATA
TGCCTAATGTCTTTCAGGCAAGATTTATTCAAGTTGTAGTTGGGAGTCTGAGAAGCGGCGTAATACCAATTACAGAAGCTGATGGAG
GTATACGAGTTAGCAGTTTTGTGGGAAGCTTGAAGACGGCTTTGGTACAGCCTGCTACAGAATAATACCAGGCCCTGGCTCCTTCA
TATAAGTTGGCTATAACTGAGAGTTGAGGACGAGGGTTCCCGACATACAACTGATCATACCCAAATTGGCGAGCAAACCTATAGGGT
TGGTAAGGCTCGACGAAACAGTTGACGCCTTGCCGAAAGATCAGGTAGCCTGGCCTGATGGATAGAAGCCAATGGAAAACACCCCTG
CTCAGCTGAGTGAATCCATTAGGACCTGCCGTATCCTGATATTCTGCCCCATAGACACCGCCTTCGAAATCAGGAAACAGCGGTAG
ATATGGAAGTTGGTGTCTCGCGCAAGGATTTGGCGAATTCTAACCATGTAACCCCCCACCCATTTCGCAGATTCTAGTCGCTGCACA
AATGGGATGAAGGAGTCTTCCGGGGGAGAGGCTGCACTCATCAAAGTAGGACAGTGAAGCACGTACCAAGCCATCAAATAGGCATAT
GGCATTGGTACCCTGGGATTGGGAGTTTTGAAAGTCTTGTGACCCTCAGACTCCATCTCTGTAACACCAACAAAGTCAGAGGCCAAC
TCCCGCAGTCCATACTGTAAGCAACCCACCATGGCGCTGAGGAGGCTCACAGGTCTCCCATGTGCTAAGAGAACAGCTGGGTAGACC
ACCTCAATAGCAAGGGCATCGATCGGCCTGGTAGGAACGACGCAACCCTTGAGCCACAACATCAAGAATCCAGCCAGCAACGCCCCG
TTGGAAATGGGAATCAGAGCTTGATAATGAAAGCTCTCAAACTCTGTGTGAGCCGGGAAAACATCTTCCTTGGCCTCATTGGTGTAA
TGGGGTAGCGTCGTCAATACCAGCCTGAACCTCTTCCAAAGTACTGACAGGTAATCGGGTCACAGAGCCTCCTTTAGTGGTCAAGT
TCTGGAATAAATATTCTGCCCAAGACACTTGTTTGATGCCGCTTCCGCGAGCCCCCGTTAGCTGCATGCAGATATGGAAGTGACACA
TCACTTCCCAGAGAGTGGCGTAAATTTCTGGCTGGTCTTCTTCAAAAGTTTAAGTTCCGTAGATCCCGGAACAAATTCTTCATAGG
GTAAATCCCCTAGAATAAGACCTGAGACTTCGTGCATCTCGTGAAGAGCGAAGCCTAACTCCTCCACAGGGGTGAAGAAAGTGCAAG
TCTCGGGACTATACTTCTCCAATATGAAAAGAAATGAAAGTGGCTCTGAATAATCCCGAACTTAGTAGCCCACACTGGAATCAGCA
ATCCAGCTTGGGCAAGAGGGGTTTCCAATTCCTCCAGAACAAACTTGGTCATCTGGGCCCACCACCCTGACACTGGAGAATGAACCC
AACCAGGAGCTCTAAATCCTTGTGCGGGGAATTCTCCTTTCTTTTCCAAAAATCTCTTAACAAAGGTCTTCGCTGGGCTGGGTACTT
CACCAAGGGGATACTCCTTAGCAAATAAACTCGGCCGCAAAGCTGTCACCTGCCGGTTATAACCAACTGTGCGGACCCCGTGAAAAG
TCAAAGTCCCGAGAGCAACCCCATCTTGATTCTTAACCAGGGGCCAATCCATATCCTTGGGACAGAAGCACACTGGAAATAAGATA
TGGGAACATCCTCTCCATATTGGCAAGAAAAGGTTGCGGTCCCCAACTTTCCCGCAACCACTTATAGTCCCCATCATAAGCAGTGC
TTGCGTCGAAGTCAACAAAGTCCCCGAAAAGATATTCAGGTTTGACTATTGGCTTACGGCTTGGGCTTTCAAGTCGGGCGTCCGTAA
CCAATGTCCTAAGAGTGTCAGAAGAAGCTTGGGTAATTATTTCTACGTGACTCTTCTCCCTAATTCGGAAAACGGGGAGTTCTTGGC
GTGAGCTGAAAGCAATGTTCATGTCCGCACCACCTTCATGCCCAAAATGGTGGAGAAAAAGAAGGGTTCACTGGTATGGCGCACTG
CAAAAGGAAGAAGAAAGTTAGATAACTCAAAAGCAAGACTCAGACGGGAGGGTCGAACCCCGCGTCAGATAAGTTCAGACGCGAGGG
TCGAACCCCGCGTCAGATAAGTTCAGACGCGAGGGTCGAACCCCGCGTCAGATAAGTTCAGACGCGAAGGACGAACCCCACGTCAGA

Fig. 13BS

TAAGTTCAGACGCGAAGGACGAACCCCGCGTCAGATAAGTTCAGACGCGAAGGCCGAACCCCACGTCAGATAAGCTTGGACGCCAAG
GATGAACTCCGCGTCAAAAAGTTCAGACGCGTAGGTCGACCCCCGCGTCAAAAATCTGAGACGCGGAGGTTGAACCCCTCGTCAAAA
ATACCAAACGACGGAGTCCAGCCCCGCGTTATTGAAACGAGTTTCCTCGTTGATGTCAAGATCGGAACTCGCCGAAGCAAGTTTAAT
GACCACGAAGGTCGTACTCACCGCCAATTAAAGGGAGTTGGGCGGCATCGGACTTGGAAGCGGCTGATTTCTTGGTGCCATTGAAA
CTCGTCGGAGGAGGTGTACAGCGTTTTGTCGGAGGTGAGAATGAAAATTTTTTCGTTAAAATTTCAAGAAGAGCCGAATGACTCTTG
ATTTGACCTCTAGCGGTCTATTTATAGACAGCTATGAGCTGTCAAATCATAACGGACAGGATTCGAGGCCATCAGCCCGGCCCAAACT
CGACCCTCGCGTTCGAGTTGTTTGAGCTTCCAAACGCGATGCCCACCTTCGCGTTCAAATTTCCCAACGCTGGGCTCACCCACGCGT
TCCAATCCTCAAAGGCAGAAATTATCTCTGTGTTTGGACCGCTATGATAGCAGCTTCTTGACTACCAAGGCTACGACACAGCCCCAG
ATGAATAAAAAAAGAGCTAACAGCAATCGTCAAGGCGACCAAAGCCGAGAAGAAACAAACGACTCCACTGGGGAGTCTATTAGAGGA
GTACAGATAGATTACAACCAACAACGGTGAAATCATCTGGCTCGATCAGACGGAGGGAGCAATCAATCCACTAAATTTTGGGATCCA
AAGTATTTTGAAAATTCGTCCCAGTCAACCGCGAATTTTCGAAAACTTTGGAGGGGGTTCTGTAGGTTGTCTAAAAATCACAATGAA
TAGCTGACCCCTATCAAGCTCCGACAAGGGAAGTCACAATCAGACGACTTTCTGATCACTGCATCCGCAACTCCACAATCGCCACAA
ACACGACCTCATTTGTGAGATGATTGATCTTGATGGCTGCGACAACAGCACGACTAATATTATATTAGCAATTATTGGAGATGCTGA
TGAGCAGTGTAATGATTTTAGAAATGAAAGGTTGGACTTAGTTGGTGAGTTGCTTGGTAGAGAGCTGTGGGCAAATATCCATCTAAA
GACACTATGGATGTTGATTCCAGTCAAGTTCCTACAACGAAAGCTACAATCAAATAGCTTTCGCGCCGACAATCGAAAGTTGGTGAG
TTGCTTGGTAGAGAGCTGGGGCTTTTCACATAGATCGAGAAGAGTTACAATTCAACGACACTTCCGACGACGGATGAAAACTCTATT
CAGCAGTCTTCACAATCTACGGTGAAAGTTACAATCTGACGACTTTCATATCCTACAACAGCTAAAGCCAGGATTACTGAACGACGG
TCCTCGCAACGCTTCATAGAAGAAGTTAAAAGTCAGAAAGCTCCTTCTGAAACGCGGATGTCATCCCCGCGTTACAATTCTGGAAGT
GCAGGCGACCCCCGCGTTTCCAAGCCACCCCCGCGTCTCTAAGATACAAGCCAAACGTGAGTGACCCTCGCGTTCGTAGGGGTCCAA
CCAACACCGACCCCCGCATTTCCAAGCAGGCAACAAGCCAAAATGCGAGCGACCCTCGCGTTCAATGATGTTCAGCTAACACCCAAC
CTCGCGTCTCAATTCTAAGAGGCGAAGTTGGGTTCTGAACGCCAGATTGGCGCGTTTGACTCGTTCAAACATGAGTCGAACGGTTTCA
GAACCATTTATCCCACGTTCTGAGGGATTTTCGCCCACGTAGGAGTGGATATAGGGGTCAGTTATAACCTCCTATCCCCCTATAAAA
ACTTAACAAACTCAACTGAGCTAAAGGTTTGATTTTCTTGGCTCAGATCGACCACAGGAGGCTGACGGTTGGAGATTTTCAGTTCAA
AAAAAAAAAAAAAGAGTGAGCAAAGATCGGATTTGGAAGATCTCAACCACTCAGGTTTTGGCGATTCAACAGCAGCAGCGAAATCCT
TGGAGATAGGATTTTTGAATCAAGCTCAGAAGATCAAATCTGAGAGGATTCTTCAACAATAGAATAACGGCTTGATCATTAACCGAA
TTTTCAGTTCTAACAACTCTATTCACAGAGTTCTAACTCGTTCAGAGTTCTTAAACTCATTCAGAGTTAAACATCAAACTTTCCACA
GAAGTTCATTATTCCCACGAGATAAGAGACGGTCGGATCGTCAACGGAGAGCAAATTCGACGCGAGCAATCGAAGGAGGCATTCCAT
CGCTACCGAGAAGAACCCAGTTTTAAACAAAGGAGAGAATCAAACTCGTTCTCTTCTCTTTTGTAATCAAGTTGTAATCGGAATCAA
AGAAATATAAATCAATTTTCTTTATTCTTTTCATTGTAATTTTTCCTACATACAATGATTATTGGTTTTGATTTGATAAGAGGTTTG
CGTTTATATAACCCTCGGATTTATTGGGTGTTTATTCCTAAATCTTGTTTACCGGGTACTAAAAGTCCTTATATGGGTTGTTACAAG
CTTAAGTGCTTGATAAATTGTTTCCTCTCTTGCATTTTGTCAAAAATCTTGTTTTGATTTCTTTCTTTGAATTCATTACACTTCACT
TATATGATGATATTTATGTGTTTGTGCTTATGGATCATCTATGTGTGCCTTATAATGTATTCTATATGTGGTTTGATCAAGTTCTAC
AAAAAAAAATTCTATTTATTGATCAAACATTGTTCTTGGACTTAAAATTTGATTTATGATTTCATTTGGTTGATTTGTTTTCATTTG
AAAACTTTTGCATTCTCATATTCCTCTTCTTTTGATTTCATAAATCTATTTTTTATACTATGTTTTCATAATTGTGTAATGAGACAC
TTCTTTCATAAATGATATATCTATATGTGTCCTCATTATATTTTTTTTATGAGTGGTGTTTAGCATATTTTTTTATCTATGCTTGCTC
ACATATATTTGCCTTGATCTTTATTGTATATTTTCCATAAGCCATTTTGATAGGGGAGCAATCCCTATACTTATTTTATACTCACC
CATGCTTATTTGTAGGGGGAGCTTTCGCTCTCTTTCATCTTTATGGTTTTTCTCCTTTTTGATGTTGCCAAAGGGGGAGAAATATTG
TGAGTATATTCTTTTTGTTTATATGCATGATATATTATACTTTGTATATTCATTTCCTTTCATGTATATATTCTTTTTGTAAATTAT
TTGTCATCATCAAAAAGGGGGAGATTGTTGGCCTCTTTGTTTTGATGATGTTTAACAAACAATTTACTACTAATATTGTTTGTCTAG
TGTTGTGTTTATCTATCTATTGTAGATAAACAACATGTTGGAGGATGGATGGAATTGTGCATTCACGATCATATCAAATGGAGGTTG
GCGGATATAGTGGTTGAAGCAATGCAATTCAAGTTCAAGATCCAAGTTCAAGCTTCATCCGTAAGATTACCAAGTCAAGCTATTTAA
GATCAAGATCAAGATTGGGTAATTTAGTTTTAGGTTTATATTATGTGTGTTAGTACTTTAAGCTCAATCATATACACACATACACAT
TTTGGTTTTGTATATATATAGTTATATATATACATATATATTTTAGTTTGATAGTTTTTAAGTTTTAATATGAAACAATTGAATATA
ATTAGAAAACATATTTTTGTTTCATACTTATATGCATATATATGATTTTATCAATATCAATTTTATTTAGTTCAATGAAATCATGTT
TTAGTGCATTATATGTGTATTTTGATAAAATACTATATTCTTTATTTATAGACTTCATAACAATAGTTTACATCTTTCTTCAAGTCT
ATAAAATCATTTTGTATTGTTTCAAAACATGGTTAAGCTAAAATGTCAAAACTCATATGTTCACATTTTCATGTTTTGGACTATTTT
GCAAAATAATAATATTTTTTATTTGGGAGGTCTTTTTTGAAAACCAGTTTTTGTAGTATGTATATTATCATGTCTACAATCATTTCC
CAAAATTTTATATTTTTTCTGAATTTATTTGATATTTTTAAACAGGGTTTTAAAATCATCAAACTGCTTCTAAACCTGTTATTTCAT
ATATCTGTTTACGGTCGACCACCCTTGTTTCCCCTTAGTAGCCAGCAGAGACTTTCGTGGTTGACCATGACGGTCGACCGTCAGTC
TGAAAAATCCCACGGTCGACCGCTACGGTCGACCGTAAAACTTTCTGGATTTTTTTTCAGACTCGAAAGTGGCTCGCAGTCGACCGT
GAAAATTCCACGGTCGACCGCCGTTCACCCCAACGGTCATTTTGGTACAGAATCAGATTTCTGATTCTTGGGCTTTTTGGTCTTTTC
CTTTGGGGTTTTTGGCTGAGGTTTTAGGAGGCTATAAATACCCCATTGCTCTCATCTTTCATGATCAACCAAGAAGTTTTTAAAACA
AAAGTTTAATAAGGGTTTAAGCTTGGTTAGTTTGTTTTAAGTTTGGGGTTTTACAAAGAGAAGTTTACATCAATTGTTGAAGAGTTT
ATCTTCAATATTTCATCATCTTCTCTTTGTGTTTATAGAGAAGTTTCCTTAACTCTATTTCCTAGCATTTTTTTATAGAGAAGTTTC
CTTAACTCTATTTCCTAGCATTTTTACTATTGTATTTCATATCAATTTTATTGCTAGTTCTTCTTGAGTTAAGTCTTATTTATTCTC
ATTGTTACACACACCCATATTGAGCTTATTGTATTTACATTAATAATATAATTTAGGTTGTGAGATTGTATCATTGAGAGTGAGCTT
ACATTGTGTTCTCATCTATATTAGAGAACAAATCATTTGTTGTATTGTGCTTATTGTGAGATTGTAAAGTTTTTGGTTAGCTAGAAA
ACAGAGTGTGTAGTGGAGATCTCCTCGAGGTGAGGAGCAGAGACGTAGGTCGTGGGGACCGAACTCCGTGAATGAGAGTGTGAGGTG
TAAATAATGTTCGGGTAAGCGTAGAAAACCCGATTGTGATAGTGGATTTCTCCCCCGGGAGTGGGGAGCGGAGATATTGGACGGAAGG
TTCGAACTTCGTGATCATATTGTGTGTTTGTATTGTTTATATTACCCTATCACAATTGTATCTTTAGTTTAGATTATTTACCCTTGT

Fig. 13BT

GTTAATTTATATATCCTTGCATATGTTTCATCATATACGATATATCTCTTTGTTCATATTACATATTCTTGCTCATAATATATTATA
TATCTATCTTGCAAGAATAATTTATTAATTAGTTTTATTAGCATAAAATCGGATTAGATTAGCATAAACCCTATTCACCCCCCCCCC
CCCTCTAGGGNNNNNNNNNNGCCCTCGGCGATAGGGTCAGTTGATCCCGCCTTTCGTGTCAGCATAAAAGAAGGTCGACTTGATGAG
TCGGAGAGGTCGAGGCCTCTGTTCGGCTTGGGCCACACAAGTGGGTTTGAGGTTATTTTGTTACAACTCTTATTGTATCATTTTACA
AATGCCCGTATCTTGGGTGAGTGAACACCATAACAGTTATCCAATAGTGACACGCGATATGTTCATGAGGTTCGGTCTTCCGACCTA
CGTCCCCGACAACCTCTCCTGATGCTAACTTCACTATCACACCCGGTTGCAAGCCCGTAACTTCTTCACAACGATCTCCCTCTTAAGA
TTTTATAATCCACACAAGTGATCTCCTCGAGATCAATCTCACCACACAATCACAATGAAAGAATCATAGGATCAAGTGAAGAACAAG
TAAAGCTCAAGGGTTGTGGAGTGTGGATTTGAGAAAAACAAAGATTTAAACACAATTGAGGATTAAGAATTGAAAGTTTAAGCTTAA
GAACACTTAGAAAACCAAACTTAAGATTTTTCTCTTGCTAAAATCATTACTGAAGTGAAGAGAGCAATGGGTATATATAGGAACCC
CAAACAATAGCCCAAATCCTAAAAATCAACTAGTACAAAAACTAGTCGTTATAGTACTGATGGATCATGTCCGGTCGATCGAATATT
TGACCATTGCAGACTCAGTAATCTGGAGCTGGTTCGGTCGACCGATAATGATGTTCCGGTCGACTGACCCTCAGTCATCGGTCGACC
GTGCAATCTAAATCGGTCGACCGCAAATGACTGTCTGCAGGGTCATGAAAATAGCTTCTTTGGTCAGTCGACCGACGGGCAAAGCTC
GATCGACCGAAAACATGTACATACAGGAATTTGATGTTAGTTGAAAATCTGACTTTGTAAAATCAAAATAAAATATCAAATAAATTC
CAAAAATTATAAAACTTTGGGAAATTCTTATAAACATGATTTTGACCATGTTAGAATAAGAATTTCTGAAAGATCATTTCCGAATAG
TTACTCTTTTTTCAAAATAGTTTAAAAACAATGCTTTTGTGAAAATATGTGTTGAACCTAATGAGCTTCAAATGTTATCAACTCAAT
AACTTGTCTACATCAAGCACTAGAGAGAAAGAAAAAGATGCAAACATCTCACATATATGAATACAATTCTTTGGTCTTGATATTTGC
TCATATTTTGATGAAGCTTCTCTTATGTATTGTGCTCTTGAAAGCTTTTCTTCACCACATTGCCTGCACCTCCATGGATATCATCGT
TGAGCTCGATTCCATCCAATCCTCCAACATTGGTACTAACTTGCTTGATAAATTATAATCTACACAATATAATCAACAAGCAATTAA
CACCAATAATGATGTTTGTAAATCATCATCAAAACAAGAGAACTAATAATCTCCCCCTTTTTGATGATGGAAAACTACCATTATTCA
AGAGCATGAATAAAATAAAATTTTAGTTTATAGATAGGTTCTCCCCCTATCTATAAGACTCTCCCCTATCTATGTGCACAAATTGAG
AGATTTCTCTCCCCTTTTGTCAACATCAAAATGGATAAACAAGATAATATACATGTGTTAAAACCCACAAGATACTCCTCTAAGTG
TTGACCTACCCGTGTCATATTCTTCAAGTGTTTGGATTTACGACCTCTTCCTAGGCATTACTACCAACCCACTCTTAGAATTAACCT
TGGTCTCTCCCAACCACTCCTCTAAGTATCCTTGTGTGTGTTTTGGTGGAAAGTTAGTTCTTTCATTAGTGGACTCATTACAACTTC
AGTCATTACAATGAACTTAATAAAAATGAAAATAAAAGATTACAACTCTCTTAAAACACACACAACAGACGTTTATCACTCGCTGTT
TATGTGGGATCTTTGCCTGTGCCGGTTTATCCGTGGACCATCGAGTGATCTGATCAAGATATAGATTTCGTTGACTGCAAAGGAGT
CAAGAAATTAAAGTAACTATCTCGGCAAAGTGAGATAATCACTCTTCTCGAGAATCACAGCTAGGTGCGATCTCAAGAAAAATGGAT
GAACGGATGTAGATCTCTTGAACTCTTCCTCTTTATGCTGAATACATTGCCGAGATCTCTTTCTCCTCTTTGAAATTCGTGCTCCTC
ACTCTTCAGTTCGACAGTGCTTTGCCGATGCTCGAGAATTTCGGATCTGTGCCGAATGAAGGCCCTAGTGCTATATTTATAGGCTTTA
GAAGCTCGGTTTTTGATTAAGAACCGCCAATTTGATCTCATCCTTATTTGTAATCACTTAACCACGTTCCAAGATAGCTTCAAATCA
GTTGGATCATAATTTACCAAAATCTCGACGGTTAACGGCGAAGAAATGGTAAAAAATAGTATTTTCTGGCCTGAGACACTCTCTGTA
TCTCGGCCCTGGCCGAGACATAGTTTGTGTCTCGGCTGGCTGAGACACTTGTTGTGTCTCGGTTTTCGACCGAGGCGTCGTTTTGCG
CGCTTTGACTGTTTTCGGCTCTAATTTTCTCCTCCAATCTCGGAATGACTTGATTCAAAGTGCGTCAGAAAGTCGAAGAAGAGATCTA
CAACTTCCTATAGGTGAATCATACGTGGAGTGGATGAGACACGAGTGGAATTTCTCCTTTCGTGAGTGAAACGTAACTTCCGATTGG
ATCGTTTCTTCGTTATTCTGTCGTTTTGTTGATTCGTACGCTTCGTAGACTCGTTTCATATGCTTGTCACCGTCAGATAATCCTCTT
TGACTTGAATAATGATGTTTATCGTCTTCTCTCCATCTCGAGTTGCGTGCGGGAACTCATAAGCAAATTTGACGCCTACAGTGTGCT
TAAACATGTTTTGACAATGTAGATCACAAAGAAAAAGTAGCTATGAAATCGATAGCTTAAAATCAATAGCAAGCAAAAGGCATCAAA
ACAAGTATTTAAAGAAAGCACATGCCTAAATCAAAAATCTTCTTCACTAAGGGGTTTGGTAAAGATATCCGCTAATTGTGATTTTGT
GTCAATGTTAACAAGGAAACATCTTTCCTATCTACATGGTCACGCAAGAAGTGATGCCGTACCTTATGTGTTTGGTTCTAGAATGT
AAAACAGAGTTTTTTGAAATATTAATTGCACTAGTGTTATCACAAAATATTTTTGTATCATAAAAATGTAAATCAAAATCAACTAAA
TTTTATTTTATCCATAAAAGTTGTNCACAACACAAGCCGGCGGCAATGTACTCCACTTTCATACTGGATAAGGTAACACAATTTTGT
TTCTTGGATGACCAAGAAACAAGTGAGTTACCCAAAAATTGACATTGTCCACTCGTACTCTTGCGGTCTACCTTTCATCCGGCAAAC
TCGGCATTACAATAACCATAAAGATCAAAAGAAGTGTTCTTAAGGTAAAACAAACCAAGTTCTATAGTGCGATGTATATATTTAATA
ATTATTTTAACCGAAATAAGATGAGATTTTCTAGGAGAAGCTTGAAAATGATGACATGCACAAACACTAAACATAATATCCGGTCTA
CTAGCGGTGAGATAAAGTAAACTACCTATCATACCTCAATAAAGCTTTTGGTCTACCTTCTCACCACTCTCATCCAAGTCCAACTTG
ATGGTGGTACTCATGGGTGTTGGTGCATGTTTAGAGTTCTCCATTCCAATCTTCTTGACCAACTCTCTTGCATATTTGCTTTGAGAC
ACGAAAATCCCATCATTGGTTTGTTTGACTTGGAGACCGAGAAAAAAAATATAAGCTCTCCCATCATGCTCACATCAAATTGTTCTT
GCATAACTTTAGAAAATTCCTTGCACAAAGATTCATTAGTGGCACCAAAAATAATGTCATCAACATAAATTTGAACCAAAATAAATT
ATTTTCCTTTTTCTAATAAATAGAGTATTATCAAATTTCCCTTTTAAAATACTATTATCAATAAGAAAACTTGAGAGGCCGAGCATAC
TAAGCTCTAGGGGCTTGTTTTAACCCATACAAAGCTTTTTATACCCGGTAAATATGATTAGGAAATAGTGGATCAATAAAACCTGGG
GGTTGCTCGACATACACCTCTTCTTCAATAAAACCATTCAAAAAGGCACTTTTAACATCTATTTGAAACAATTTGAAAATTTTAAAG
CTAGCAAAGGCTAAAAATATTCTAATCTGCTCCAATCTTGCAACTGATGTAAAAGTTTCATCATAATCAATGCCCTCCTCTTGATTG
TATCCTTGGGCAACTATACGAGATTTATTTCTAGTCATTATGCCAAATTCATCAAGTTTATTTCTAAAAAACCTTTTTGTTCCAATA
ACATGAAAATCTTTAGGTCTAGGAACAAGTTTCCAAATATTATTTCTTTAAAAATTGTTTAATTCATCATGCATAGATAAGATCCAA
AATTCATCATTCAAAGCATCATCAACACGTTTAGGCTCAATTTGGGATAAGAAAGCTACATTACCACACTCGCTCATAGCCTTTGAG
CGAGTTAAAACTCCTTTAGATAGGCTTCCTATAATTTACTCCTTGGGATGATCCGGTGCAAATCTCCATGTCTTGGGAAGTTCCTCT
TGATTTTGTTCAAGGTTCCTTTCCCTATCTTTGGGTGCATCCGTTGAGGGTTTGTCATTTACTTACATAAGTTCCAATCCTTCCTCA
ATATTATCATCATCCCTAGGCACACAATCTAGCAAGCCATCATTAGTTTCATCAAAGGTAACGTTTATAGATTCTTCAACAACAAGT
GTTCGTTTGTTGAAAACTCTATAAACCTTACTCCTTGATGCATATCCCAAAAATACACCAAAATTAATATTTGAATCAAATTTATCA
TGGTGATCTTTTATGTTCAAAATAAAACATCTGCAACCAAAAATTTGGAAATAGCTAATATTTATAGTTTTGCCAAAATAAAGTTCA
TAAGGAGTTTTCTTGAAAATATGTCTAATTAAAACATGTTTTAAAACATAGCAAGCCGTGTTGACGGCTTTCGCCTAAAAATATTTT

Fig. 13BU

GGCAAATCAAAATCATTAATCATAATACGTGCCATCTCTTATATGGTACGATTTTTCCGTTTAACTATACAATTTTGTTGTGGTGTT
TTTAGAGCGGAAAACGTAGGTGTAATACCATGATGCTCACAAAAAATCACTAAAAACTTTATTTTAAAATTCACCACCATGATCCCTT
CTAATTGTTTGTGGAAAATTTGCAGTAAAAGAAACGAAGGAAAATTGATTTGTATTCCTTTAATCTCGATTACAATTGGATTTCCTG
ATTATAAAAGAGAAGAGAATAAATTTGATTCTCCCCTTTGTTTAATTCTGGTTCTTCACGGTGGCGATGAGATGCCTCCCTCGAAT
GCTCGGGTCGACGTTGCTTCTCGTTGACGATCCGACGTCTTGTTTCACTGGAACGTGGTCTTCTCCTCACGATTTGACGTTGTGGAG
AACTCTGAACGAGTTTAAAACTCTATGAAAGAGTTGATTTAACCGAAAGTCGGTTATAAGCCAAGGATGAAGAAGATCTTGTTGCCG
ATCTCCAAAGCTCCAGAAAATGCTCTAAGGATCCTGTTGACGAGCCAAGAAGTTCCAACAGATCCCCCCTTGAACTGAATTGATTTTC
AGTTATTTATAGGGGATTAAGGGGTGTAACCACCTCCTTAATTCGCTCCTAAGTGGGGCTAATGAGATGTAACCGCCCCTTAAATCA
CTCCTGAGTGGAGTTGTGATCCCCTCAGATCGTGGGAAACGGTTTTGGAACCGTTCAGCTCGTGTTTGAATGAGTCAAACGCAGGCC
CGCGTTCTGGCATGAATTCTGTGTCCAAACGCAATGCCTAAAAGCTTGAACGCAGCATCTGGAAGCTCGGACGCAGCGTTTGGAAGC
TCATTTGCATCGATTTAAGAGCTGCGTTTGGCAGCGAATCTGAGCTGCGTTTACAGCAATTTGGAAGCTGTGTTTGTATGATTTAAG
AGCTGCGTTTGGCAATGGATCTGAGCTGCGTTTGGAGCTGGATGTGACCTGTGTTTATAGCGTTTGAAGGCTGCGTTTACAGTGATT
TGGAAGCTGCGTTGGCGGCCGAATCTGAGCTGTGTTTGCAACTTTTGGAGCTGCGTTTGCAACTTTTGGAGCTGCATTTGAGCTGCG
TTCGTGGCTATGAACGCGGCGCATCTTGATGCTGGTACGCGGAGAGGACTTTCACGTCTTGATTTGAAGAGACCGTCGATTTGTCGT
CTCTTTCTATCGAAGTTTTGCAAAGATCGTCATTTTGTAATCCTTACTTTAGCTCTTTGATATACAAGAGTCGTCAGATTGTAACTG
TCGATGTTGATTGTGAAGGCTGTTAAACTAGAGCTCTCATCGGTTGTCGTGAAGGTCGTCAGATTGTAACCTTCAGCGATCTACGTG
AAAGTCTTCAAATTGTAGCATTCAGGAAGTCGTCAGATTGTAACTTCCATCATCGGTGTTTTTATGGGATAGCTATCTATTGTGAT
TTTTAGACAGCCTACAGAACCCCCTCCAAAGTTTTCGAAAGTTCGCGGTTGACTGGGACGAATTTTCGGAATACTTTGGATCTCAAC
TCTGATCTTGGAGCTGTTGATTCCTTGTGGTAAAGGATTTATTCTCTGCACTTGCTTCGAAGGCATCATGGTTGAAGGGATTTGCCA
CGTAGGACCTGTGTGAAGGTATGCGCCATAATCCTGCTTCTGGAATGTGGGGTGGACCCTGCATTTTGAACTTGAGATGCGAGTCT
CACCCTTGCATGTTGAATTTGGAACACGGGTGTGACCTCGGCGTTCGGTTTTTGCATCGCGGGTCTGACCTCAACGTTTTGACTTAA
GACATGGAAGTGGCTTCCGTGCATTTTTGACTAAGTCTTTGAGACTTGTCTTTGGCTCATCTGTTTTAAGTCTCGGCTCACATCCAT
TAAGCTGATGGACCTGCAAACGTGCATAGGATTTTTGGCAAACCCTCAGCCATCAACGGATTTGATAAGCCTTTACCGACTACCGTT
TGAGTCGGGCTAGCATGTGGATTGTCTAAGTCCGTTCCACATGTAACGTTGTGCTAAGAGAATGAACCCTCTTAGACTTGATGCTAT
GATTTTGAATACATAGACTTTGTCATTTTCACGGGAAACGACTAACCGGCAACGCGTGTTAGGCGTAGGCTTATCTCTAATTAGGGA
TCGAGATAAAGTCCCCCATGCGTGTAAGGCATGGATTTCGGTGTTATTAATAACAACCTGCCACGATGTTGAATACGTGGACTTTGT
CGTTATTTCTTCCTGTGTTACTGAAAGAAAGTTAGAAACGCCAGAGGTGTAATATTAACTTGGCATGAATTTTCACTTAGAGTGAAA
TTCAGAAATTTTCTTTATTATCACTAGGATAATTCTAGAAAAATCTTTAATTCACTGGGCATTTTACAATGACAACTTGCTATTCTTG
TTGAAAAAGGATTAACAAGTTCATTGGGGGGTTTGACTGTTAGAGGTGTGATGTTAACCTAACAGTATTTTTATGGACCTATCGCTC
CATTGAAGAGAGTCGATAAGTTGATTGTGTCGTCAGAGGTGTGATGTTAACTTGACGGGTAATAGACATATCGCTCTATTGAGGAGA
GTCGATAAGTTGGTTTTGTCAGAGGTGTAGGATTAACGTGACAAGAGAATGTTGCGATCGGAGCAACTTTGTGGACTTATCATCCTA
TTGAAGAGGATTAATAAGTGGATTTGTCAGAGGTATGGTGTTAACATGACAAGAGAATATGTTACGATCGGAGCAACTTTGTGGACT
TATCATCCTATTGAAGAGGATTGATAAGTTGATTGTCAGAGGTGTGATATTAACGTGACAGGATTTGTGTTGCGATTGGAGCAACTT
TGTGGACTTATCATCCTATTGACGAGGATTGATAAGTGGACTGTCAGAGGTATGATATTAACGTGACAAGAGAATGTGTTGCGATTG
GAGCAACTTTGTGGACTTATCATCCTATTGACGAGGATTGATAAGTGGATTGTCAGAGGTATGGTGTTAACATGACAAGAGGATGTG
TTGCGATTGAAGCAACTTTGTGGACTTATCATCCTATTGACGAGGATTGATAAGTGGATTGTCAGAGGTATGGTGTTAACATGACAA
GAGGATGTGTTGCGATTGAAGCAACTTTGTGGACTTATCATCCTATTGAAGAAGATTGATAAGTGGATTTTGTCAGAGGTGTGATAT
TAACGTGATAGGAAGATGTTGCGATCAGGGCAACTTTGAGGACCTATCGCTCTATTAAAGAGAGTCGATAAGTTGATTTTGTCAGAG
GTTTAGTGTTAACATGACAGGAATTTGTGTTGTGATTGGAGCAACTTTGTGGACTTATCATCCTATTGACGAGGATTGATAAGTGAA
TTTGTCAGAGGTTTAGTGTTAACGTGACGAGAGTTGTGTTGCGATCGGAGCAACTTTGTGGACTTATCATCCTATTGACGAGGATTG
ATAAGTGAGTTGTCAGAGGTTTAGTGTTAACGTGACAGGATTTGTGTTGCGATCGGAGCAACTTTGTGGACTTATCATCCTATTGAA
GAGGATTGATAAGTAGGTTGTCAGAGGTGTGATATTAACATGACAGGATTTGTGTACTTGTAATTTGAACAAGATTTTGGGGACTAG
CGTCTCGCTGGGGAGAATTGCTAAGTGAGTTTATCATCAGAAGCGATGAATTTTGATACTAAGATTTTGAAGACTTAGCGTCTTGCT
GGGGAAGATTGCGATTTGAGCAATTTTGAGGACTCATAATCCTATTGTCAAGGATTGATAAGTTGATTGTTGTCAGAGGTATATTGT
TAACGTGACAAATTGGGAGTGATGCAAGTTGAATGCATACTCTGTGGGGATGATGATCGTCAGAAGTGTAATGTTAACTTGACGATG
TAAAAGATTCGTTACTCTTAATCCAGTGGATTCCAAGTAACCAACCTCCAGTCTTGATTAAGACTTAGCAGGGGAATAAGAAGAAGT
AGATAAGGCACATCACGTAGTGGGACACTATCCATGAAGTCGGAACAGAGGCACATCACCTGGTAGGCCATTATCTGATGAGTTTGA
CTATCAGAGGTAACTGTTAACGTGATAGTTTTGTGGACCCGCCATCCTACTTGAAGAGGATTGGTGGGGAATTTGGAGGAAAAGGA
CTATCAGAGGTGATGGTTAACGTGATAGTTTTGGTGGACCCGCCATCCTACTTGAAGAGGATTGGTGGGGAATTTAGAGGAAAATG
ACTATTAGAGGTGACGGTTAACGTGATAGTTTTGGTGGACCCGTCATCCTACTTGAAGAGGATTGGTGGGGAAATTTGGAAGAAATG
AACTATCAGAGTTAATTGTTAACGTGATAGTTATGGTGGACCCGCCATCCTACTTGAAGAGGATTGGTGGGGAATTTGGAGGAAAA
GGACTATCAGATGTGACGGTTAACGTGATAGTTTTGGTGGACCCGCCATCCTACTTGAAGAGGATTGGTGGGGAATATGGAAGAAA
TGAACTATCAGAGGTAATTGTTAACGTGATAGTTATGATGGACCCGCCATCCTACTTGAAGAGGATTGGTGGGGAATTTGGAAGAA
ATGAACTATCAGAGGTGACGGTTAACGTGATAGTTTTGGTGGATTTTGTGGTTGACCGAGGTGTTCTATTGAACATGACAACTCAAA
AAAATTTATTGGTCATAATCGAATGAACTACAAATAAACCAACCCCCAGTCTTGAACAAGTGCAGGGGAAAAGGGTAGACATGGCA
CATCGCCTAATGGGCCACTATCTAATGAGGTTGACTATCAGAGGTAATTATTAACGTGATAGTTGTTGGACCTGCCATCCTACTGAA
GAGGATTAGCTTCAATAGTCGTGGTATCTTCTTCTGACTGAGAAGATTGGCCTTGGTCCGATTGCTCAGGTTGATCCTGCCTACTTT
GTTCTTCAGCTTTGATCCTGACAATAATCTTTTGAGCCTGTTCGCCTTGAGAGATTAGTTGTCTCCAAGAACGACATTCTGCAACTC
CGATTCGGGCTAGGAGGTCGGTTTGCAAATTGTGCTGACAGGTCTCCACTAGGGTAGATTGTGTCATACCTGACGAACACCGGAGAG
CCATGGTTCGGAACCTCTTGACGAAGGCTTTGACGGACTCCCTCTTCTTCTGCTTAGTGGCGAGAAGGGTATGGATGGAGACTTCCG

Fig. 13BV

TATCCTCTTCAAAGAATCTCGACAGGAAGAGTCTTTCTAGATCCGCCCACTTTTGGATACATCGAGCAGGCAGTTTCCTGAACCATT
CAAAGGCAACTCCCTTGAGGGTGCCAATGAACAATCGAGCCAGTATGACGTCGTTTGATATTATATTCCCAGTCTGTGACTTGAAGT
GATAGATATGTTGGTTCGGTGAACCCGTACCGTCAAAAGTTTGTATCGTCGGGACCTCAAACTTGGGAGGATAAGGGGCTGTATCCT
ATTCGGCAGGATAGGGCCTGGCAACTCCATCGTCTTGGAGCTCACTTCTGTCAACAATGGCATTGAGGCGGGCTTCCAATTCTTCCA
TTTTGGCAGATTGGAGATTCTGCTCGTTCTCCGTCTCTCTTCCTTCATCAGAGGAAGATTCTAAGTTGTGGGCTTCTTAGTCAGAAG
CCGTGTCATCAACCACTGAAAACACTTTTTCGAAACGAGCTTTAGAGAGAGATTTTGGTTTTTCCGCACCCGCAAGCCCAGCCCAAGC
CTATTTTCCCCTTCCCTTTACTTGTGTGAAGTCGGGATGAAGACGTTTTTCCTCTCCGGGAGGATTCTTGCCTAGGTGGCAACTCTG
TCTTCTGAGATTTAGCCTTGTCTGCCGACGAGTTGAGTCAACAGGTCTAGGAGTTCATTGAGAGTCTTCTGCTGTGATTTGAGCATGC
CGTCTTGCTCAGCAACCCTCTTTGAAAGATCTTCAGAATGTTCTGCCATGTGGGTGAAGCTCTCATGCCCAATGAAAGAGCTTGATG
ATTAAGACTCAGCAATGCCTGAATGTTCATCATCGAAATTAGTTCCTGTGGCTAACCTCCGATAGTTGACAGGGGGAATGGCTCCCG
TTCGAGTCTGAGTATGTTGATAAACTCCTTCAAACTCGTCTGTGATTTCTCTGACGGTCAGTGAACGCCTTGTCTCAGAGTCATTGG
AACTAGGACCTGAGGTTTTCCCTCTGCCGATCACATTGATAGTGACCTCGGGTCGTTGTTGGTTGGGCAAGGCAACATGCATTAATT
GGTCGAACACCAATTGTTTGGCCGCAAATGAACAACATTGACATCCCGAGAGGACTGTAGGAATCAGTCGTTCACATTGGAATGAAC
GAATGACTTGTTGCATCGGTCTTTCTCTTGATATGAACTCTCTCAAATCTATTGTAAAGATTCGAAGAGAATTACTCACTGATTGTG
AGGTTTGAATTGGAACCCCCAGTCTATGATTGGGTAGGACTGGCTCTTGGTGAACATGAATCTAGTTTAGATGCCTTGGATCCATGA
ACTTCTTATATCCGCCCCTCGATCTAATTGCGTTTCATCAGCGAGCCGGGGGTCACGATATATACCAGGCTCTGTATTGGATTTCAT
CAACTGAACGCATGCCTGAGCTTCAGGTTTTGCTGATCAAACGCATATTTGAGAGTTGCGTTTATTTTGTGGAACCGCAGCCCTGAGG
GTTGCGTTCATTTTGTGGAACGCGCCCTGAGGGTTGCGCTCAGTCTTCTTCACACAGAGCCTATGTTTGGGCTCATAGACGCGAGA
CTTGCATTCTGAAACAGAAACGCAGGGCATAGGGTCGTGTTTAGGCTCACAAACACCAAGCTCGTGTTGACTTAAGGATCGACATTC
TCGGAGATGTGCTCGTCGTAGGGATCTCCTCCTGCGTCGAGCAGCATTCTTCTTAGCCCACTTCAAGGCCTTTGTAGCGACGTCACC
ATCTGTGTTGATCAAGTTTGTCGCCTCAATGAGCATCTTTCGACCGGATACCTGTCGTCTTGGCACAGGTTTGGCTGAAGCTAAGCC
CACTCCATCGGCGGAGGGGCTGTCCGAACAGTCTTCCTTAGGCGGTTCGGCTGCAATTAGAGCAGTTGGAGCTTTAGTCTCTTTGGA
GACTTTGTGGATCTTGCGCATAGCCTTGGGGCTAAGGGATCCGGAGGAGAGGGCTTCCTCATACTTGGCTTGATCGAACTCTATGAC
TAGAGTTTCAACCGTGGTTCCAGTGAGATGAACATCGGATTGCACCACCACTTCTTCGTCAGAGAAGCTAGTTTCCCCAGCGGAGTC
GCCATCTTTTGTTTGTGGAAAATTTGCAGTAAAAGAAACAAAGGAAAATTGATTTGTATTCCTTTAATCTCGATTACAATTGGATTT
CCTGATTACAAAAGAGAAGAGAATGAATTTGATTCTCCCCTTTGTTTAATTCTGGGTTCTTCACGGTGGCGATGAGATGCCTCCCTC
GAATGCTCGCCGTCGAGTTTGCTTCTCGTTGACGATCCGACGTCTTGTTTCACTGGAACGTGGTCTTCTCCTCACGATTTGACGTTGT
GGAGAACTCTGAACGAGTTTAAAACTCTATGAAAGAGTTGATTTAACCGAAACTCGGTTATAAGCCAAGCATGAACAAGCATCTTGTT
GCCGATCTCAAAAGCTCCAACCGATCCAACTCCTCGATCTGATTATAAAAAATCCAATCCTTTAACTCTCGTTGACTTTGTTGTTATT
TATAGGGGATTAAGGGGTGTAACCACCTCCTTAATTCGCTCCTAAGTGGGGCTAATGGGATGTAACCGCCCCTTAAATCACTCCTGA
GTGGAGTTGTGATCCCCTCAGATCGTGGGAAACGGTTTTGGAACCGTTCAGCTCGTGTTTGAACGAGTCAAACACAGGCCCGCGTTC
TGGCATGAATTCTGTGTCCAAACGCAATGCCTAAAAGCTTGAACGCAGCATCTGGAAGCTCGGACGCAGCGTTTGGAAGCTCATTTG
CAGCGATTTAAGAGCTGTGTTTGGCAGCGGATCTGAGCTGCGTTTACAGCAATTTGAAAACTGCGTTTGTACGATTTAAGAGCTGCG
TTTGGCAACGGATCTGAGCTGCGTTTGGAGCTGGATGTGACCTGCGTTTACGGCGTTTGAAGGCTGCGTTTATAGCAATTTGGAAGC
TGCGTTGGCGGCCGAATCTGAGCTGCGTTTGTAACTTTTGGAACTGCGTTTGCAACTTTTGGAGCTGCATTTGAGCTGCGTTCGTGG
CTATGAATGCGGCGCATCTTGATGCTGGTACGCGGGAGGACTTTCACGTCTTGATTTGAAGAGACCGTCAATTTGTAGTCTCTTTC
TATCGAAGTTTTGCAAAGATCGTCATTTTATAATCTTTACTTTAGCTCTTTGATATACAAGAGTCGTCAGATTGTAACTCTTGATGT
TGTGAATGCTGTTAAACTAGAGCTCTCATCGGTTGTCGTGAAGGTCGTCAGATTGTAACCTTCAGCGATCTACGTGAAAGTCTTCAA
ATTGTAGCCTTCTGGAAGTCGTCAGATTGTAACTTCCATCATCGGTGTTTTTATGAGGATCAGCTATCTATTGTGATTTTTTGACAG
CCTACACTAATTTTTACAACTTTCAAATCCTTTTTATTTTCAATTCTTTTTACTAAATGAGAGAATTTTTCAAAACATTCATCTTTA
TTAGCAAGAAATATAACCCATGTAAAGCGTGAAAAATCATCAACAATAACAAACACATAATGCTTTCCTCCTAATGAGGCAACACGC
ATAAGACTAAATAAATCAAGATGAAGCAATTGTAAAGCTTTAGTGGTGGATACCTCATTTATAGATTTAAAACAGTTTTTGATTTGT
TTACCTTTGGTACATTCCTCACATTGAGAATCTTTAATGCATGTTAGACTTGGTAGTCCTCTTACCAAGTTCTTCTTTGATAGCTTA
GAGATTAACCTCATGTGAGCATGACCAAGTCTTTTGCACCAAATCCAAGGATCTCCATCCACCGTGACAAGACACTTCACATCTTGA
TCTAAAAGCTCATTCATCTCAAATATATATACATTAGACTTTCTAAGGGCAACAAAAATTGCTTTATCTTTTAGACTTACAATACAC
TTATCCGGTTTAAAAATAACATCATAGCCTTTGTCACTAAGTTGACTAATACTTAAGAGATTATGATTAAGTCCTTTTACCAAATAA
ACATCCTTAATCACGGGATAATATATCTTACCAATATTACCATTACCCACAATTTTACCTTTCTCACCGTCACCAAAGGAGACATTG
CCTCCTTCTATCCTTGATAGAGTTACAAATAAGTCATTATCACCCGTTATGTGATGAGAGTAACCACTATTAAGGCACCACAACTCT
CTACGTCTTGTACGAGATGTTCCCTACATGTAAACAAGAGGTAGAAGCTTTAGATACACAAATCTTTGGTCCTTGGATATTAGTACA
CTTGGCACCCTTAGCTACCCACATCAACCCATAATAATAAGCATTATCTCTAAATCTACAATGTGTAGACGTGTGGCCATGTCTCAT
GCAATATGTGCAAACAAAATCTTTCTTATAAGTAGGGGTATGAGATCTATGATGCTATGTTCTTCTAAGGTGGTGATGAGTATTACT
AGAAGAAGCATAATTAGTTTTATCTTTAATTTTTAATCTTTCAATTTGAGACCTTAAATGTTTATTTTCAAATTCAAGATCTCCAAT
TATTTTGTCTTGTAAAGCACTAACATCATTTAGTGAGGATTGTAAAAGCTTAAACTTTGAGTCACATGAATCATGCAAATTTTTAAA
AGAAGAATGTTCTTTTGCTAATTTTTTAAATTCAAAATTCAATTCTTCTAGTGTTCCAAGTTCACATTACATATAAAAAGATTCATT
ATTGGAATAGGATTGTACCTCATCTTCATGAGCCATGAAGCATATATTTGTATCATAAAGAGCAATCTTGGCGGCTTTGATGCGGCA
TAAATATGTACCAAAAATGTTGCAAGTGCACAACCGTCTCAAGTTATAGTATAAAGATATCGATCCACGAGGAAGCTGTTTTGTAGG
AAAAAATATAAAATCAGTTCTTATGTTGTGTGCAAGACAAATAGGAGTGATAAGTGAATGTGATTATGGAGAGATGAAAATGATTGT
GTAAATGAATATATTTGAGAGTGGAAGTGATAATATAAATGTGATCAACAAGGCAAGAAGGAAAAATCAAGAACAAATAAAAATCAA
GAATGTAAAGATAGTGGATTCAATTAAAGATATGGGTAATCTAGAATTGAATCCACTTCTTAGAAAAATATGATTCCCTAGAGGGTT
CTAGCCTAAAGGCGAATCAAAAAAAATAAAAATGAATAAAAAGAAAAACTAAACCCAAGAGGGTTCTAGCCTCAAGGTGAATAGTGC

Fig. 13BW

AAGAAATTAAAATCTAACTACAAAATAAATTGTAAAATCTAAACTACAAAATAAATTGCAAGAATTAAATAAAAAAAAAATCTACTC
TATAAGCATGAAATATATCTAATCTATAAGTATGAAATAAATCTAAGGCAAGAGGGTTCTAGCCTATTGGCTATTTAAACAAGAAAA
TAAAATCTAATTACAAATCTAAGGCAAGAGGGTTCTAGCCTATTGGCTATTTAAACAAGAAAATAAAATCTAATTACAAGCATGAAA
ATAAATCTAAACTAATAAGCAATAAAAGAGAAATAAGAAAAAATAAACCTTCAAATTAATCTCCATCTTCATCTTTGATACGAGTTGC
CATGCGAGCATCTTTGATCGCGGAATTATCAAAGGTGGGTTGAGAAGAGGATAACAGAAACACAAGCACAATTCAATATATGGCGAA
GGAAATTACCTTCTCTAGATTATGAGTATGAAAAAATTATAATCTCTCTCTCACAATCTCACTAGAATCGAGAACAAACTCTTAATT
CTCACTAAACCCTAATACAATGATTAGAATCTCTCTTAATTACCTCTCTTATAGTTTAGAAACCCTAAAACAATCTTTTATATAGGT
ATATAAACGTGGATGGTAATTTGGTAAATAACCAGACATAAAACCAACAGGAATTCGTGTGAACAGAAACCCAAACGAACCAGGAAA
CCATCGATGAGTCGACTCATGACTGAGATGAGTCGACTCGTCCGAAACCGGACAAAACACAAAAACCAGCGAAATGAGTCGATTCAT
GACAGTCATGAGTCGACTCAACCTGATGAGTCGACTCATGACTTTGTTATGAGGACTCACAGGCTGAAAACTGGATACTTCGATTCT
TCTGCTCGTCGTCTCGTTCCACGCTTCCTCCTGCGTTTCCTTATACTGTTTGACACCTCTATTCTTATGTTATCATGAGAATCATCT
ATCCTCAAGCTCCCATGAGGATCGCTAAGTTCCGAAGAGAAGATACACCCGTATCATGGGTCCCCTCTTTAAGAACTTGAAGTCCCA
TTCAAGTTAGAACCTTTGCTGAGGAAACTCTCGAGCTCCTCCATCTTTTCTGTACCACCTGGCCTTGCTAGGAATCCGGTCTCAACA
TTCGATCAGAAACAACTCATTCGTCCCGCGTCTCGTCATAGTCACCGTTCGCTCTAAGTTGCAATCCTTTGTCGATGGCTTTTCTAG
AAGTCTAATGCACAGCGAGACAAACTTCTTGCTTGCATTCATTAGTCTCTTCGCTCGCGCTACCGTCCCCAAACTTGTCTCCTTCAG
AAGAGATGCCGAACGAAATATGAACTTTACACCATCCTTAGTGAAGGTGTACTTCTGAGCCCGCCTCTTGTAGATCGCATATCTATC
CCATAAGTACGGATTACCTAGTATAATCTGACAAACATCCAATGGAACGACGTCATACGTGACCTCGTCAATATACGACCCGTGGAG
TGCAAATCTGACAGTGCATTGATCAACTACACTCAGTTTCTCCTCCTTCTGAATCCACCCCAATAGATAGGGCTTCAGATGCTTGAC
TGTCTTCAGACCCAGCTTCTGCACCAATGCCTCGGATATCAAATTCTTCTCGCTGCCTGAATCAACAATGGCATCAACCAAACTGGT
CTTCACTTGCAACTTAAGAACAAAGAGTTGCTCTCTCAGGTCGTCGTCCTCTTTCGTGGTCTACTTCTCCATCATAAGGTTGAGACT
GTTGTTGGGCTCTGTCATCCCTGGGACTTTTTTCGGACCTTGAGCTATCATGTATGCTTTTTTCTCCTCCTTCTTCTTCAACCCTCT
TGGCTTGAGATGGGGATACTTCTCCCAGCACCGATCAGCTGTGTGCCCTGTCTTCTCGCAGTGACTACAAATCAGCCCTGTCTTCCC
TAGATCACCCTTCTTCTTCTCCTCCTTAGATTGAGAACCACTAGACTCGCCTCCGGTCTGTTTGGAGTCTCCCTTAGCCTCGTTGCC
CTTCTTTTGCTTGCCCTCGATGGCAATAGCCTTCACGCTCGCCTCTGTAATAGTCTCGACTGTGAATAACTTCATCTCCTTTCGGAT
GTAATCGCTCAATCCTGCCATTTACTTCATAAACACGAAATATTCCTCTGTCGCAATGTTGAGGACCATCGCCTGCTGCTGGAACTC
CGTGGTGTATTCTTAAACGGTTTGATTGACCCTTTGGCGTAAGCCGTACCACTTGTACCAACATTCTTTAAGGAATCCCACTGGGTA
GAACTGCTTTCTCAGTAACTCATTGAACTTGTTCCACAACACCGCCTTCTTCTCCTGCTTGCAGTAGGATTTCACCACGTAAACGT
GTGCCCGGAAAGCTTCAAAGTCGCGAACACAATCTTCTCTTTTGACGAATAGCCATAAAGAGTAAAATACGTCTCCATCCGCTCGAT
CCAGTCATCAAGCCTCTCGACGTTAACACTCCCATCATAAACAGGAATCTCCACCTTGAAGTCAATCTTCAGGTTCTGATAAGATCT
TACCCCCTTGATGCAATGCAGTCTTAACGGTCTCCTCCTCCTCATCGGAATCTGAATCTACTCTCTCCACATCGGACTCAACAATTT
TCTTCGAAGAAGATTCACCTTGTTTTCCACCTCCATGGATAAGACTGACGAGTTGTGTGAGAGTCGAACCTATCGTCTCGATCTGCT
TCTCCAATGCATCAATCCTCGTTGAATTGTCTCCTTCGACCATCTTCTTCTTCGTTAAAACATGGACTCCTTCCAATGAAATAACGA
TCTCGCCAAGCTTCTTGTATTGGGATCGAGTAAGGACCATACATAGGATGCCCCTTCACCGGATCTGATGCTCTGATACCACCTTGA
TACGAGTTGCCGTGTGAGCACCTTTGATTGTCGAATTATTAAAGGCGGGTTGAGAAGAGGATGACAGAAACACAAGCACAATTCAGT
ATATGGCGAAGAAAATTACCTTCTCTAGATTATGAGTATGAAAAGATTACAATCCCTCTCTCACAATCTCACTAGAATCGAGAACAA
ACTCTCAATTCTCACTAAACCCTAATACAATGATTAGAATCTCTCTTAATTACCTCTCTTATTGTTTAGAAACCCTAAAACAATCAT
TTATATAGGTGTACAAACGTGGATGGCAATTTGGTAAATAACCAGACACAAAACCAACAGGAATTTGTGTGAACAGAAACCCAAACG
AACCAGGAAACCATCGATGTGTCGACCCATGACTGAGATGAGTCGACTCGTCCGAAACTGGACAAAACTCAAAAACCAGCGATGAGT
CGACTCATGACAGTCATGAGTCGACTCAACCTGGTGAGTTGACTCATGACTGTTATGAGTCGACTCACAGGCTGAAAACTAGATACT
TCGATTCTTCTGCTCATCGTCTCGTTTCACGCTTCCTCCTGCGTTCCCTTGTACTGTTTGACACCTCTATTCTCATGTTATCATGAG
AATCATCTATCCTCAAGCTCTCATGAGGATCGCTAAGTTCCGAAGAGAAGATACACCCGTATCAATCTTTAACTTCATCATCCAACA
AAGAGAAGAAGAGAAAAATTTAAAGTGGTAAAAAATTTATTTTATTAATTGTAATAAAAAGTTATAAATTTGAAGGTCTTCTCAAT
TAAGAGTAGCCCTCCTCTCCAAAAGGAGTTACAAAAATTTTCACACCTCTAACCCCTCACTCTCAACCCCTATTTATAGTAAACATC
AGTGAATGAGAGCCATTGGATCAAACTTGATCCCCAAGAATGCAATTATCAGCCATTGACGCGCGCTACAGTAATCTGGTATCGATG
CCCGCATTAATGCTGGCATCGATGCTCCAATAAAAATTTTAACTTCACGGTTGGCTTCGTCTCGTCGAGATAGGTGATTTTCATATA
TTATATGTTAAATTCCGCCTTCCGGATTAGGAGATATAGTCATTTCTTTGCGGCCAACTATCTTGAATACATTTTTTTCATATTTAA
TTTTTTTATTTTCTCCGGATTCTACAAGCTACTCGGCTTGATTCTGGGCTTGGGCTTTTTGACTCTTGCTTGTGTTCTTCATTTAAT
TCATGGGTTTTTATTGAGATAAGAGATCTTGGGCTTTATTCTTCACTAACCTGCAATTAAAGATAAAAACAATTATTAATGGCATAT
TTATTCATATAAAATAGATAATGAGGGTATAAATATGTAATAAAATATGATTATTAAATACCCCACACCTAAACTTTTGCTAGTCCT
CTAGCAAAGAAAGAAAAATGAAAGAAGACCTAACTCACTTTTTGCAGGAATCGCGGTTGTATTCAGCCCATACAACAAGCCTTTAAA
CCCCTAGGTTACCCTAGTAGACGAGTTATAGTCTCATGAGGGTTTGCAGTGAATATACCCACAAAATTCGGTCTACTTGCCAAATTA
AAGAAGTCAGTAAATAACTAAATTCACTTGATAACTTTAGACAATCTAATTGAAGCTAGTTATCACTCAAGAAAAAGTTTTTATAAA
TAACTTAAAGGTAAATTTCCTAGAAAATCTTCTCATTATAGCAATACAAAACCAAGCCAAACTTAGAAATTTAACTTAAAAGTTTTG
AAAAGAACATGCTAACTCTTTGTTTAAAATAATATTCAATTTGCTTGATCTAAAATATTTTCCAAGATCATATATACAAATATAACT
AAAATATTTATTAGTATTTTTATTTTTTTTATATATATTTTTATATTATTATTATTTTTTAACTCTTTCTTCCTTGGTGATTTTTTC
TACTTTAACGGGTTTTCTAAGCGACCATTTAACGAGTTTTAGGCCAATGGATCCCAACCCATTTAGGCTTAGATCATTACGTATGGA
AATACTCCTTGGGATTAATTACTCGGTCAACTTAGGCTTTATAAGATAGAATCACCTTGAATTTAAGAGTTTTTTTCTTTTGGTGTC
TATTTTTCGCACTCTTCTTTTGTTATATTTTTATGTATATGTATATATATTCTGAAAAATATGTAAGTCAAGACACTTTGAAAATTT
ATTTTTGACTCTAAGCTAAGCATGCATAAATTCCATTATTTTAAATAAAAATCTAAGTTAAGACTTAAGTGAAGTATTCTACTTTGA
AAATTATTTCTTAAGAAATTTATTTAGAGTTATCATAAAAGGTAAACTTGAGTAAATAACAAACTAGAGATTAGAAAATTTAAAATT

Fig. 13BX

TATCAAATAAATCAATTATTACATAACTCTATCAATTTGGCAAGTGACGATATTTTTATAAATTTTTTTAAGGAAAAGGAAAAAAATG
ACAAAAAATGCAACTAAAAAATGTAAAATAAAGAGAAAAAAAATAACTAATTCTCACCCCCACATCTAAATTTTACATTATCCTCAATGC
AAACTCCATGATGCACAAAGTAAAGCAGATAAGAAGTGAAGTACTTACATTTGATTAGCTGATAAAAAATCTACAATTATCTTTGATC
TGAGGAGGATAGAAACAAAAAAATTATTATTCTCTTCTTTTTTTCTTTTTTTCTGTTTTTTTTTACAACTGAACAAGAAAACTCTCAAATG
AGAGAAGAATAAATTCTTTTTATTATTCTGAAATAAACAAAAAAAAATAATGTAGAATGAAGTGTTCAACACGAAGAGCTCGTATTCT
ACCTTGAATCCTACCTTATTGTTGAAAATTCTTTCCCGAATTTTAAATAAATTCAGAATGATATAATCAATAATGTGAAATTCCAAA
CATTTCGGGGTGTTCAATAATTCTTGCAACAAAGTAAGGTAGGTATTATTGGTGTCATGCATTTTGTATTTTTTAATGAACTTAGAC
TCTTGTACTGTGAAGTTTTATTTTCTAACAACCAATTCTTCTGTAGAGTTCTGAAAATTTAGTTGTTGATTTTTCTCCAAGAATCTA
AGTTCATCAAGAAAGAGTTCTTCAAAATTTAATTCAAAACAGCACATGTTTAACACAGTTTTATTATTCTCAAGGACCTGATCTGCT
TCTTCTAAAAACTCTAACTCTTCATCAAAAATTTCCTCAAAACTCAAATCAGACTCTTCTTCTTCTTCTGAACTTTCCTGAATATAA
TTTATTTCTAGAGGCTGATTATTTGGATTTGGTTGGTCCCCTGGATTAAAAAATGTTGAGATCAGCAGTCAAATTCCCAAAGGACAGC
TTTATTTGACCAGTTCTACAGTTGATGAGAGCATTAGAAGTGGCTAAGAAAAGTCATCCTAAGATGACAGGTGTCTGTCCTTTGGGA
TTAGAAACAGGCTGTGTTTCCAAGACTACAAAATCTACTGGAAAAATAAAATCTCCAACCTTAATCAGAACATCCTCTAACTCACCC
ATGGGTACCTTAACAGATCTATCAGCCAACTGTAAGGTGTATCTGGTTGGGTTCAGTACACATAGACCCAATTGCTGGTAGACTGAA
TATGGAAGCAAATTAACACTGGCCCTTAAGTCTAACAGCGCCTTATCAATGTGAGTATTATCAATGATACATGAAATGATGGGGAA
CCTGGATCTTTACGTTTCAAAGGTATGGGATTTGATAGTATTTCACTGATATTGGCGGCTAAAAAGACTTTCTTTGGAACATTTATT
CTCCTCTTCTTAGTCCATAATTTTTTTTAAAAAATTTAGCATAAGATGGAATTTGTTCAATTACATCTAAGAGAAGATGTTGACCTTA
ACCTGCTTGAATGTTTCTAGGACCTTCTCCTCCTGAGGAGAGTATTTCCTAGGCCTGAGTCTATCTAGAAAGGGAGCAACTGGTCTA
AATCTATCAAAAATAGGCTCAGGTTCGGTTCAAGTTCTTGGTCATCTAAGGGGGGTGATTGTTGAATAGATTCATCAAAAGGAGAA
GGAGAAGGAATTTATATTAGATCAAAAGTTTGACTTGGAGGAGTTCTCACTTGATTATCTACCTGTCTACCTGACTGAAGTGAATGG
ATTGCATTCACTTGAGCTTCATAGGATGAACTGCATCCTGTGTCTTTAGGGTTTACCACGGGTTGACTCGAAAATTTTCCTTTCTCT
CTTTCACTCACGGCACTAGTTAGTTGACCAAGTTGGGATTCTAATTTAGCTATAGCTTGAGTGTTGGAGTTGAGCATTTGTCCAGTT
GATTGCATGAAGGAATTCAGAGTGCTAGACGTTTGAGTCAACATATTCGTGGTTTGAGTGGATGCCTTAATTATGGTTTCCAAACCT
CTTTCCAAGACATTGAGATGGTTATCCTGATCTGAATTGTGATGAGCCTGAATTACAGCTTGATGAAGAGGAGACTGATTTTGATAC
GACAGATTGGGTTGTTAAAATTGTGGATGAGAATTAAAAGGATTTGTGTTTTCCCTAGGAAAATGTTGGGTGGAAGCGGGAGTGAAG
TTTTGAGTTCCGAGAGAATTTCCTTGATTCTATGCAAAGTTGGGATGATTTCTTCAACCTGGATTGTAGGTTGGAGAAAATGGATTA
TTTCTAGGGCGTTGGAATACAACGTTCATCTGTTCTCATGCATAGTTATTTCCTAGGAGAGGACATTCCTCTGAAACGTGGGTAGGA
GACTGACAATTATGATATCCTGGGGTAGAAACATGATTGATTTGAGCTAGAGCTTGTTCCTTAATTTCTAAGGCTTCTAACCTCCGC
AGAATTATCGTCATCTTCGCTTCAGAAGTAATGTTTGACTCCAAGGAAAGACCATTAGACTTAGAATGGGGAACTGATAAAACCATG
TTATCACAGTGTTCCCATTGCATTGTTTTCTCGGATAGACTCTCTAGAAATTCCCAAGCTTCATCGGTATTTTTCCTCATAAAATCC
CCATGGCACATTGATTCTAAGGAAGTTTTTGTAGAATAATCTAATCCCTCATAAATTATTTGGCACAATCACCATTTTTCTAAACCG
TGATGAGGACATTAGATGAGAAGATCTTTAAATCGGTCAAAATACTTCCAAAAAGGTTCTCCTAGGATAATTTTAAAATTCATGATG
CTGTTTCTTAGCTTTATCGTTTTATGGATAGGAATTTTTTTTTTTTAAGAAAAACGGTGATAAATTCCTCCCAAGTAGTGATGGAATT
TACGGTAAGCTATACAACCATTTTTTTACTTTGTCTTTAAGAGCAAATGGAATAAATCTGAGTTTGATCGCATCTTCTGTTAATTC
TCTCATTTTAATCATAATACACACTTCCTCAAATTCCAAGATAAAAATATATGCATCTTCTGTTTCATTTCCAAGGAATTTGGGAAG
CATATTTATGTAATACGCTCTAAGCTCAAAATTTATTCCATTTGTTTCGGGGAGCCTAATACAAGAGGGGATTGCATTCCTAATGGG
ATAGCACATATCTTGAAGAACGGGTGGATTAGGATACGCTATTTCTATGATTGGTTCAAAGCGAATTAATCGATGTGTATTATCCCT
AATCCACGGTTGCATACACCAAAACTATTTCTTTTTATACTTTTTTTTATTATTATAAAGGTTAGTTTTTTTTAATGAGGAGAGAATG
GAAAAAGAGAAAAAAAATCCTAACTAAACAAATCAAAATCAATCACTTTCCAATCACTCTAACTCTAGGGTTAAGCTTAACTCAACTA
GACTACCTCCTAACCAAAAACTCCTAAAGTGAAAAGATTAAAGTTTTACCCGGGTAGTTAGCCAGGTAAGGATAGTACTAGAGGGTG
ATCAAAGATCAATTAAGTACCTCTTTCCTTGCGGAGCGCTTTACGCAACCCCTAAACCTTGCCTTAGACACCAACTATTCTGAGAAA
ACTTAAACCGGTTCACTTAAGGATTTCTTGTTCCTTATTGAGCTCGAATCCTTAGGGGCCAACGTCTAATGAGTTTTATTAGGCTTG
GGTGGTGTAGTGAGGAATTAGTGATTTTTAGGCTAAGGGAAGGGTGATGAAATCTCTCACATTATCTTGAATATTAGGTTTTACCCT
TAAAAATATTTTTAAGTGTGTGCCAAATCAAGATGCTCAAATCACTTGGTGAATTCCTACTAACAATATGAAATGAAACCCAATGAA
TTAAAAGCAACTAAAAAGGATGGAAAAGAAAAAACCTTTTTTTTTTAATTAGGGTTAACAATTAAACAAATGAGAAGGGGATATTAT
TTGAATTTATTATCTTGTTAGTAAATGTCAAAGTGGAGGGTGAATTTTATTATGGTCAACAAAAATAAAATCTCTTTTTTTAAGTCC
TAATTGTCTCTAATTGTGAAGAAGTAGCTAAAGGGTGGAATTAAAAATTCTAAAAAGAAGAATTACCTACAAGCAAATCTTCAAATC
CTAGTTCTCCAATCCGCGATCTTCAAGCTTCAAGCGTTTCCTTCACAATAAACACACAAGTTAAAGAACCAAAATAATTAAAACATA
CTTAAGCACCTTCCCCGGCAATGACGTCAAAAACTTGATGCGGCATAAATATGTACCAAAAATGTTGCAAGTGCACAACCGTGTCAA
GTTATAGTATAAAGATATCGATCCACGAGGAAGGTGTTTTGTAGGAGAAAATATAAAATCGGTTCTTATGTTGTGTGCGTGACAAAT
AGGAGTGATAAGTGAATGTGATTGTGGAAAGATGAAAATGATTATGTAAATGAATATATTTGAGAGTGGAAGTGATAATGTAAATGT
GATCAACAAGGCAAGAAGGAAAAATCAAGAACAAATAAAAATCAAGAATGTAAAGATAGCCGATTCAATTAAAGATATGGGTAACCT
AGAATTGAATCCACTTCTTAGAAAAATATGATTCCCTAGAGGGTTCTAGCCTAAAGGCAAATAAAAAAAATAAAAATGAATAAAAAG
AAAAACTAAATCCAAGAGGGTTCTAGCCTCAAGGTGAATAGTATAAAAAATTAAAATCTAACTACAAAATAAATTACAAAATCTAAA
CTACAAAATAAATTACAAGAATTAAATCCAAAAAAAATAAATCTACTCTATAAGCATGAAATAAATCTAATCTATAAGCATGAAATA
AATCTAAGGCAAGAGGGTTCTAGCCTCTTGGCTATTTAAACAAGAAAATAAAATCTATTTGCAAGCATGAAAATAAATCTAAACTAA
TAAGCAATTAAAGAGAAATAAGAAAAACATACCTTCAAATTAATCTCCATCTTCATCTTCATCTTCATCATCCAACAAAGAGAAGAA
GAGAAAAATTTACAGTGGTAAAAAAAATTATTTTATTAATTGTAATAAAAAGTTATAAATTTGGAAGGCCTTCTCAATTAAAAGTAG
CCCTCCTCTCCAAAAAGAGTTACAAAAATTTTCACACCTCTAACCCCTCACTCTCAACCCCTATTTATAGTAAACATCAGTGAATGA
GACCCCTTGGATCAAACTTGAGCCCCAAGAATGCAATTTCGGCCGTTGATGAAATCTGGATGACTTCGCATCGATACAGGCATCGAT

Fig. 13BY

GCCCGCATCGATACTGGCATCGATGCTCCAATAAAAATTTTGACTTTACGGTTAGCTTGGTCTCGTCGAGATAGCCGATTTTCATAT
ATTATATGTTAAATTTTGCCTTTCGGATTGGAACATATCGTCGTTTCTTTACGGCCAACTATCTTGAATATATTTTTTTCATATTTA
ATTTTTTTATTTTCTCCGGCTTCTACAGGCTACTCGGCTTGATTCTGGGCTTGGGCTTTTTGACTCTTGCTTGTGTTCTTCATTTAA
TTTATGGGTTTTTGTTAAGATAAGAGATCTTGGGTTTTATTCTTTACTAACCTGCAATTAAAGATAAAAACAATTATTAATGGCATA
TTTATTCATATAAAATAGATAATAAGGGTATAAAATTGTAATAAAATGTGATTATCAGGCTTCTTCGTCACTATCCGAGTCGCTTGG
TTCGGATTTCTCCCATCCCGCATACATTGCCTTCTTCTTTTTGTACTTCATGTACTTCTCTTTTATCTTGGGACAATCCTTTGCTAT
GTGTCCCCGTTTATTGCACTCAAAACATTTACCTACACGAGAGGGGAACTTGTTACAATGATTTTTAAAAATTTTATTCATCTTTAT
TAATCTTGATATCCTTCTAGAGAGGTGTGCCACTTCTTTAGAGACATCTACTTCACTATCCGAGGAGGAGGAATCATCAATTGCTCC
TTTGAGCGTAATTGTTTTCATCTTTTGGGAAGGCTCTTCATTTGCTCGAGAGGGCACTTCCTCCTTCTCCTTGATCTTCTTCTCATA
GACCTTGAGCTTGCCAATGAGACCATCAAGTGTAAATGTTCTGAGATCATTGACTTCCTCGATAGCCGTAGTTTTAGGCTCCCATGC
CGGCGTTAAAGAGTAAAGAATTTTATAATTCTTCTCTTGGTTCTCCAACACCTTGTCAAGGCCATGCAATTCATTAACAATGTTAGT
AAATCGAGAAAACATGGCATCAATTGACTCATTAGGAAGCATCTTAAATAACTCATAATCATGCATGAGGCTACTAATTTTGAACTC
TTTGACTTGGGGGTTCCTTCATGAGTAACACATAGTTTCTCCCAAATCTTATGTGCGATTGCACATATGGAGACCCTATTGTACTCA
TTTGGGGTGAGACCACAAATCAAAGCGTTCATGGTTTTAACATTTAGGTTAGCCAAATGCCTTTCATGCTTGGTCATATCTTTACTA
GACTTCTCAACATATTTCTTCTCTATTATTTCTAGGATGTCAAGTTCAATGCATCGTAAGTAAATTCTCATCCTAGCTTTCCAATAT
GCAAAATTATTGTCGGTGAACAAAGAGGGTATAGTGGTGGATTGACCTTCAAGCATATGCACATTCATTGTAGAATCCATTTGGATC
TTTTCTCTAAGGTGTTAGACCTAATAAATATGTAGAGACCTTGCTCTGATACCAATTGAAATTACCTTAAGGGGGTGAATAGGGTAA
TGTGACAATAAATGTGCAATTAAAATTTGTCAATGTAACACACCAACCAAATTAAATGCAAAGGCAATAAATAAAGAAAGAGTTTAG
AGAATAGTTATCCAATAGTGACACACGATAAGTTCACGAGGTTCGATCCTCCGACCTACGTCCCGACCACCTCTCCCGATGGTAACT
TTACTATCACACCCGGTTTGAAAGCCGGAACTTCTTCACAATGATCTCCTTTTAAGATTTTACAATCCACACGAGTGATCTCCTCGA
GATCAATCTCACCACACAATCACAATGAAAGAATGAAAAACTCTCACAACAATCCTATGACAAGGATCAAGTGAAGAACAAGTAAAG
CTCAAGGGTTGTGGAGTGTGGATGTGAGAAAAACAAAGGATTAAACACAATTGAGGATTAAGAATTGAAAGTTTGAGCTTAAGAACA
CTTAGAAAACTAAACTTAAGATTTTTCTCTTGCTAAAATCATTACTGAAGTGAAGAGAGCAATGGGGTATATATAGGAACCCCAAAC
AATAGCCCAAATTCCAAACAAGTACCAAAATCCTGAAAATCAACTGGTACAAAAACTAGCCATTATAGAAGATCCGGTCGATCGATG
GATAATGTCCGGTCGACTGAATATTTGACCGTTGCAGACTCAGCAATCTGGAACTGGTTCCGTCGACCGACAATGATGTTCCGGTTG
ACTGACCCTTAGTCATCGATCGACCGCGCAATGTAAATCGGTTGACCGCAAGTGACTATTTGCAGGTCATGAAAACAGCTTCTCTA
GTTGGTCGACCGACGGGCAAAGCCCGGTCGACCGAAAACATGTACATACAGGAATTTAATGTTAGTTGAAAATCTGACTTTGTAAAA
TCAAAATAAAATATCAAATAAATTCCAAAAATTATAAAACTTTAGAAAATGCTTATAAACATGATTTTGAACATGTTACAACAAGAA
TTTCTGAAAGATCATTTTCCAATAGTAAAACTGCTCATTTTTCAAAATAGTTCAAAAACAATGTTTTTGTGAAAATGTATGTTGAAC
CTAATGAGCTTCAAATGTTATCAACTCAATAACTTGTCTACATCAAGCACTTGAGAGAAAGAGAAAGATGCAAATATCTATATGAAT
ACAATTCTTTGGTCTTGATATTTGCTCATATTTTGATGAAGCTTCTCTTATGTATTGTGCTCTTGAAAGCTTTGCTTCAACACATTT
CCTCCACCTCCATGGATATCATCGTTGAGCTTGATTCCATCCAATCCTCCAACATTAACACTAACTTGCTTGATAAATTATAATCTA
CACAATATAACTCAACAAGCAATTAGCACCAATAATGATCTTTGTAAATCATCATCAAAACAAGAGAACTAACAGCAAGTGCTTTAC
GATCGAGCACCTTCCACTTATCATCGTCCATCTTCTCAGGTTTCCCCGCCTCTACTTGGAGGGGTATGAAGAGATCCTTTTGCTACA
AATAGTCTTTCATCTGCATCCTCTAATACCTAAAATTTTGGCCGCCGAACTTTTCAATCCGAAGTATGTTATCTTCAACTGTAGATC
CCATAGCAAAAGATTCCGTCTTTCCCAAACCGTATGCTCTGATACCACTTGTTAGGGTACACGCTAACAAGAAAGCCTCAAATGGAG
ACGCAAAACACACCCAAACGATCTTAGAATCACATAATAGAACCAATAAACACGAATTCAATCACAGTACTCACAGATATAACGTGG
TTCACTCTTACGGAGCTACTCCACGGTGCAACGACGACGCCCAATTCCTTTATATTCCTTTCGAGGTTACAAAAATAAAGATAAAAC
AGAACACCCTCTCTTGTTCAATACACTCTCCAAGAATTCTTACAAACTCTCTCTCAAGACCTCTCAATGATATCACTTATATCTGTA
TCTTTCTCTTTCTCTCTCTGCTACTGAGATACCTTACAAATCAAACTTAGGGGGATATTTATAAATTTTCTCATGGGGCAGGTGAA
CACTATTTGGGACAGGTGAACACTGTAGCAGGGGGTAGGTGAACATTGTAGCACGGGGGTAGGTGAACACTGCTAGCTCTTTGATGA
GAAGGCTATCCACTCTCTCAACAGAGGTAACTGCATTTATTTCACTAGAAGATTACATTGTGAGGAAGATAGTGGAAAGGCACCATG
GAAAGTGTTTGATTTGGGTACTCGGTAGGGTGCGGATTTTGGTGCTTCCAAATGCCTCGCATATTGAGAATCCTCAGCAACTATTCA
CGCCAAGCTTATGTTAGTCTTGTGACCTCATTGACTGGTCATATTTCAGTATTTTTTTTTTTAATTCTCGTTTGGAATGCTTGTTTAA
AGAATTTTGCTTTGATGGTAATGTAGATTTTTATTTCAATTATATCATGTTTTACACATACCAGAATGGAAAACGCTTTGACAATTA
ATGACATGAAGTTTGCATAAATGAACAAATTTGCACAAGTGTACAAGTCTCTCACTCATCCGTAGTCTTTCTCATGAAGCTATCAAC
ATATAAACCTCATGAATTTCCACATTAATTTTATAATAAATTTATAACAAACAATTACTTTGAGCAGGAATTGGAGAAACACAACCA
CCAAGCACAGACTTGCACATGCAAAACTACTAAAGGAAACAATTTGAATCATAACCATGTGAAATGGAAGAAGATATGAACCTTGTT
TCCATGGAAAAGCAAGCTATTTTCCCTTCACAATTTATGCCTGAAACTTGCAGCTTTCTATTTATGGAGTTAACTTACAGTAGGAAA
TAAATGTTGTAATGTGAATGCTTCATTTTTTAGAAAATCATGTGCAGTAATTTTTAGAACTATTGCACTCATCTGTCTTGCTTTGTC
TTATTAGTTATTTCTTTGCTTCAACAACGGAAACTGCAGTATCAGAACAAAAATGAAGAGAACTACTGTAAGTGTAAACTGATTTGA
TGCACTACAGCTGTATTGGTGACATATGAACAAAAACATAATAAACATGTGTCATGTTTACTAAAAAGACACTAAATAATTAGTAAAA
GAAACAAAAATCAAGCTCAGGTCAGACAACGATATTCCTAGCAGTTTTAGGACCAACAATAGAATTGATACCCTACAGTGATATTGG
TGATCAACTTGAATGAAGCACAACAATTATGACCTCTGTTAAAAAGAAAATTGATACAAAAGCGAAAATGCTACTTAAAAAATTAGC
TAATGCTGAAATATACTTAAAGGTTGTAAATACACAAGTACATTACAGAAATATTAAAAAGAAAGACAATAAGGAGCTGCATAAATT
CACATGGTTCAATGGCTCCATTCACACCAAGTAACAAAAGGGATTTAGTAAATGTATTATGAGAAGTAGACTAATATAATTCTCGAT
CCCAAATATAATTAAATCTCAAATGATGCATCATAAATCTCACACTAAAAAGATGGTTTCAAAACATTTCATTGTAATCATACACAT
TAATAGAACTATGCAAGAAGTATAAGTTTGAGGAATAAACATGAAATCTATTATGAGGGTGGTTGAGGTTGCTGTCAACATTAAAGA
AAATTAACTATATGGGCTTCCTTGTCTTTTTCACTCCTCAATTAGGAGTGAAAAAACAGGTTTTAATTTGTTTGAATGTACACCAGA
CAATGAAGCTATATTGTAGCTAAGTGGAATAGAGAAACAATGAGGTAATCGGATATTTACTGCAAAATTATGGTGAGCATTTTACCA

Fig. 13BZ

TAAAAGTATTTGGGCTACAAAGAACAAGCAATAAAATAATAGCTGCTGTTCATATTCACTGACCAGAGAAAAACTTAGGATTAAACA
TCACAAGGATATATTACCCGTGTAAAGGCTATAGGATTGTTAACATGAAGAAGAAAAAAGATAGGATGCTAATATCGCTAGTATGTAT
CAAAGAAGTTGATGTTATCTATTACATTGTCAAAGGCTATATAAAGAACATGTTGTTCTCAAGCCACAAACAAAGAGTTAAATTTAC
ACTGGATACCATTAGTTGTGCTCCTCCACTCTCATAGTGGAGAAGCGAAATTAAGCACAGTTTTCTCACACTAAATGCTCCACAGAT
ACTCAAACCCCAGCACGAAACCCTACCGTTGAGATCAACATTTATGAATCCCGGGAAAGGCCTGCAAAGAAAGACTGAGATCAGATA
AGACAAAACAATAACAAAGTTTTGGAAATCAAGGAATAACAGAGAAAATTAAATTGGCTCGAAGAACTAATCATTTCTTGTTATGTC
ATCGACACTAATGCATTTGCATTTATTGGTTGCCAGATACTATGCATTAAATCATGAGCAGAAACTAAGAGTATCACTACACTAGAA
AAAATTATAACTGGAAGTAAGACATGGAACTGAACATTTGAAAGACAAACACCCTCAAAGAGCCACTATTTAAATGTAATTAAAACA
TAGCTCCCAGATTCCATTTGGCTAATGCAAAGGCATGCCTTCAAGCTTCTCTTATTAAATGGCACCCGAACAAAATCCAAGATCTTG
CAAGAAAGGCACATGGTTTTATTAATATTTGACTTGGGCACAGAAGCAAGAACAAAATCCAAGATCTTGCAAGAAAGGCACATGGTT
TTATTAATATTTGACTTGGGCACAGAAGCAACCAAGTTGAGTTCAGGGTGTGGAAAGAATAAAATCTGAGACATTGTTACACATTAC
CTTTTAAAGCCATTTTTATTCAATCTTGAGCAAAAACCAAAAAAAAATATGAAGCTTTTTCAGTTGATATTAGCCTATTCATCCTTG
TCATTGTCTCAAATTACAATGCTTACAGCCACACAGCCATGACAAAAGACTGGGATCAAGACTGGAATCATCCATACATTTTCGAGT
ATGAGAGTTACATTAACTACACTTATTATAAGAAAGGATGCCATAGATTGTTTGAGTGATGGTGAGACCTAATACTAGAGCTCCTAC
AATGAGTGAGCAACTTACCCATGGATTCGCAAAGTATCTCTGCTTAAAGTTGGCTTGCCACCTGTTCCATCTTCTATTGCAATACTC
ATTGATGTCCTTGGTTACATCAACATCAACATTGTCGACAACTTTTGCAACTATACCTTTTGTCAGTCCATTAAAAAGATCGGCTAT
CCTCTTATCACTGCTTACCCCGACCTGATAATACCCTTCTCTCGAAGCAACGCAATATCTTTGTCATTGTTTACAATGCCATCCAT
AACCCGACCTGATAATACCCTTCTCTCGAAGCAAGGCAATATCTTTGTCATTGTTTACAATGCCATCCATAAAAAAACACATAGGATG
TTACCTCTTGACCTTCGCCATGTGCTTGCTCATAGGCAATGAGATTCCGCATAACAACTTCAAATGCTTCGTCAACGTCGACTGCAG
GTAGGCAAAGGACACCTTTGGTGAAGCATATATCTGTCAATGACAGCGTTTCACTGCACTGGAAAATTACGCCCGCCTCCTGTAGTT
CAACTGCCGATAGTGGTTGGCGACTGCTGGTGTGATGATAACCTCCATGCTGTATAAGAGTTTTTTTGTACACATCCAGTAGGTGAT
GCCCTGTTATCTCGGGTAGGTGAAATATCGTAGAGGTTTGGCTAATATCATATCTTCCCTCTTCATATTTGCGGAAGAAGAAATGTC
TGATCAGCTGATGAATGCTTTGGATCTGGAAGACAGAAAAAAGTTATTTGCTTTAAGCAACAGCATAAATTACGATAGCTTTATAAA
GGGATCCATACACAAAGTTCAACACTTAACAGCAAATAGTGTCTTCTGCAGGATTTCAATAAAGTTTATCTATCCAGAAGTTATTTA
TCCAGGTCTTAGTTCAATAGAGCATATATGATGTATATGCAAATAGTGTCTTCTGCATGATTTCAATATGGTGACTGCTTTCTTGAG
CATGCACATTACTCATTTATTTGCAAAAAAAATCTCATGGGAATGATATCTTCAATGGATAGCAAATTTTGTGCGAGTATCCTCCTTG
CATAATGTATCATTTCATACAACCGTGACTGTTAGGTTAATCTTGCATTACGAGGTATGAAAATTTTGTGCAACTTCTTCTGGAGTT
ACAGCTGGGACATTTCAACGTATGAAGATTTAGATTTCATTAACATTCCTTACCTTGTTCTTGCAGAATTTAGACAATATCTCCAGC
ACCTTCATTGGAATTTGATTATCCAACCTGAGCATATCTACACGAAGATCTTCGACCAAGTATGGCTTCTTGAATATTGGGTCCTTG
GCATGATAGCTAGAAGGTGTGCGCTCATATGGTTCAACGGTCGCTATCATGATTTCAATCATGAAAGCCCCATCGTAAATCATGATT
TTTAGGAACTCATCATCATTCTTCATCCAAAAGGTGTCAAGATCTTGATAGCAGGCTCTGAAATCGTGCAGGTTCTTCCTCAGGGCT
CGTATGATGTCATGGATCGACACTTGACATCGGATGAGGAAGTTCAGTAGCGCCCTGTGTTTATGACGTTCCATACGAAGGAGATTC
AGATCTCCATTGTACCGTGGTCCAATGCTGCACGTTGATGGCTTATGGATCTGTGGGCTAATCCTTTTGAATGTGTCTGGTACGTCG
TAGATTGAATGACGACTCCAGGCCTCCGCCATCAGGGCATTTGTGCTATTGAGCCACCCTATATCCGATGTCAATCGAGAAACCCAG
GCTTCAGACATGTTCTTGAATCTTGTTCAAGAAGGTGAATCTTGGAACTTGGAGAAGACAGGTTTGAGAAGGGAGCTCGAAGGCAGG
CGAATGCAGAGGGCTGATATGGGACCGGCGGGTTTGCTGTCAGGAGATGGTAATTGTTGTGAAGGTGCATATGAGGTGATGAGGTTT
ATCGTCTCTATGAATGTTGTCACCTGGAGTTGAGTTCGTGTCGCTAGAATAACTAGAGGGTATAAAGGGGAGGTTCAGTTAATCTTC
CTCCCTCACCAGTGAAATGGAAAATAAAAGCCTCTTTCGGCCTCTTCCTGTTATTAATTTTTCTCTTCTTTTTTTTTCGGTTTTTTT
TCTTTTGTTTTGCGTTTGGTTAGGAGAGCAAGAATTTAAAATTGGGAAAGTTGTGTGAAGGCCCTAAAATTTAAACTTTGATGTGTC
TCAAGCCACCGTATTATTTCCCTCTTGTATTTTAGCCCCAAATACATTGCATCTTTTTGATTCAGCCCTCTTTTCACTCTACCCCAA
GAAATGTCGTTTGAGAATTCCGAAAAGACCCCTCTTCGATCTCATAACTTTCGTCCCATTTGTGATTCAGCCTCATCTCTTTCTACT
CTCTCCTTAGCCTCCTCCTCTCCCTCTTCATCTTCTCCTTGGCATCTGCCGTCTAACTCTGTCGCCTTGCCCTTCGCCACTACCGAC
CTTGAGCTCATGCTCAACTTGTTTGACAAGATCTTCTCCTTCAAACTCGCTGCCATCTACTCCTTTCTCGAGCTCGTCGTCATTCTC
AACTTTCGATTCAACCTCCTCTCCTACTTTCTCCTAACCCTCCTCCTCTCCCTCTTCATCTTTCCGTCGAATCCCATCGTCTATCTC
TCCCCATCCCCCAGTGCCAACACCACCAACCTTGAGCTCATCCCTACTAGTTCGACAAGATCTTCTCCTCCGATCTCGCTGCCATCT
TCTCCTCTCTCTATGACTCAGTCTTGTTTATTTTATTCTTGTAGAAACTGTAAAATTTATGTTTCGATGAGTGAGAACGGTAGAAAC
TGATGATGGGTACAAATTATTTGGAAGAAGTTGATAATGGTCTTAGTTGAAATTTTAGAGAAGGAAATTTTTTCTTTTTTTCCTTATT
CCTGATTTTTTGTAATAATTTAAGTTGGGGGAATAGGACGAAGTTTCCTCATAAGCTTGAAGAATGTGATTATCGTGTGACTTGGGT
TGTAAGCGTAGAATATGCCTTTTTTCCTCCCACAAACAATGGTAATTTTGTGTGCTAGGAATCTAATGACTTGTAAAGTTAAAAAAT
CGAGAAAACAGTGGAATTGCGTATAATATAGATAATTGTGATGGATTATTTGGTGAAAATTGGAGATGGTTATTTGAAATTTTTTGG
GGATAAAATTTCTTTCACTTGTATGGTTCTCGTGTTGTTGTGAACTATTAAGAATAAAAGTTTACTAAAAAATTACTTTAAAGCAAA
AAAAAAAAAGATGGCAAAGCTTTACTAGCACTAATGTTGAAACCCAGGATTAGTTTACCGCCATGCTTGCTTGCAACAAGCCCATAA
AAATAACATGGACTTTTAAAGATAAATGCATATGTTTAGGCCAATCCAAAAAGCCCGTCAGTCCGGGCCCGGTCCGGGGTTGGCCCT
TTAAAGCAAAAAAAAAAAAAGATGGCAAAGCTTTACTAGCACTAATGTTGAAACCCAGGATTAGTTTACCGCCATGCTTGCTTGCAAC
AAGCCCATAAAAATAACATGGACTTTTAAAGATAAATGCATATGTTTAGGCCAATCCAAAAAGCCCGTCAGTCCGGGCCCGGTCCGG
GGTTGGCCCNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNN

Fig. 13CA

NNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNTGGCGATTTGGCGATTTGGCGATTTTGGCGATTCTGCATTCCCCTGTTGTGGCTTCGGCCATGCAA
GGCCGGGATTCATCTAATCTTCAGGATAGCAGAGCTTTTCTCAATAATGAGGATGATGACCTAGATTGGATTAATGTAGTGCAGCGT
AAAAGAAGGTATCGTAAATGGCGATTTGGCGATTTGGCGATTTTGGCGATTCTGCATTCCCCTGTTGTGGCTTCGGCCATGCAAGGC
CGGGATTCATCTAATCTTCAGGATAGCAGAGCTTTTCTCAATAATGAGGATGATGACCTAGATTGGATTAATGTAGTGCAGCGTAAA
AGAAGGTATCGTAAACCCTTACCCAAACCAATTGATTCAAAATCTAATGCTCATACTCGTATTCAAAATGTTTCGAACAAGGAGGTT
GGAAGGCATCATCTAGCAGAATTAAAGGGTAAGGTGTTCCAAAAAACCAAATCTTTCTGACTCCTGGAAATTTAAATCTGGTGGTACT
ACATCATGGAAAGACATTTGTACTATGGGACGTGAGATAAATCAAAGCTGTTCTTTAGAATACTTTCCTCCATCGATTGATAGTAAT
GGTCTCCGTTATGCATCTATACCTAGATCTGAGATTCTCCTTAATGTGGAAAAAATGGAATAACACTTTAGTTGGTTATGTCCTCGGA
GATAAACCTTTTTATTCACACTTGAAAGGATGTGTTGGTCGTCTTTGGAAACTTTCATGCTCCCTTGATATTTATTCTAGAGAGAAT
GGTTTGAAAGGATGTGTTGGTCGTCTTTGGAAACTTTCATGCTCCCTTGATATTTATTCTAGAGAGAATGGTTTTTTTCTTCTTTAAA
TTTGGTTCAAATGAAGAGTTAAACAAGGTTTTAAATGGTGGGCCTTGGTTGTTTGATGGCAGATTGATTATTTTGAAAAAAATGGACT
GAAAATATTGGATTAGAAAGAGAACTTCTTAACTCAGTTCAAGTTTGGATTAGATTTCCATCGCTGCACCTTAAACTGTGGTCTAAT
AATATTATTGGGCGTATTGCTAGTCTTGTGGGTAATCCTCTTTATATTGATCAAGCTACTGCAACTGGTGAGAGACTAGCCTATGCT
AGATGCTTTGTGGAGATCTCCTCTAACATGAAGCTTCCAAATTCTGTAAGGTTGGATCTCGGAAATGGAGAATGGTTAGAAACTATT
GTGGAGTATGAATGGGTTCCTCCTAAATGTGGTAAATGCTTAAATTTTGGACATGTTGATTATCAATGTTCTGTACAACTTGTTGAG
AAATGGGTCCCTAAAGAGACTGTAAATAACAATGAAAAGGAAAAGAATGATGCAATTCCTATTACAGTATTATGGAAGACAGACATG
ATTGACAATCAGCAAAATGGTATTCCAGATGTTATTCCTACCAATTCAGGGAATGTTATTATTTCTGGCTCAAGTTCTGATAACTCA
AAAAATGTTATTGATATTGATACTCCTCTGGTAGTAGTTCCATGCTGTTCTGATACAGATAATGTAAATACAGATAATGGAGTTCAT
TTAAACTCTATATCTTCTACAAAATCTGATTCTATCTATACAAATGCCATTTTTATGAAAGTTAATATTAATGCAGAGGATGTTGTT
ATTAAAGAAAATTTTTCTCAGGAAAATCAGGAGGTTGATGATAATGAGGAGCTACCAAATAATGAAGATGCAAATGCTGAGGATTTG
TTTCATGATAAAGCTATTAGAATTGATGTCCATTCTGGAGCTGCAGTCTTATTAAAGCATAATGACTACATTGATACAGAAATGAAT
TCTGATAATCATACTCATACCAACTCTATAAATTCAGGTTTTCAAGATCAACCCAAAAAAAGCATAGGAATGAATATATCTGTGCAA
TCCGATGGGGAAAATGGGAACGGGACAGGTATTGATTTTCCTATTGCAATTGATAACCCTGATTGGATAAATGGTAAAAATCAGCTG
TTGATGAAGAAGAAAAATAACCAGGTGAAGATAAATAGAGATTCTTCTTTAGGCCCTAAGAGAGTTACAAGGGCATCATCAAATACT
ACCTCATGACAATGCTATTCTGGAATGTAAGGGCCATGAATAATTTGAGTAGGAGAAAGGATATTAAAAGACATATTAAATCATTGA
ATCCTAGTGTTGTGGGTTTGTTAGAGACCAAAGTAAAATCTGAAAAGTCTTACAGGGTGTCCAAATGTATCCCTCCTCACTGGTCAT
ACTGTAATAATTATACTGCTTCTAGTAGAGGAAGAATTTGGGTAGCTTGGGATGAAGAGGTCTGGAAGGGTACAATTTTATCTATTA
CTTTACAACACATTACAATAATGCTCCAGAATTGTGGTGGTTTCAATCTAATGTTGAGTGTCATTTATGGAGAAAATTCTGAAACAT
TAAGATCTACTTTATGGGCTGATATTTCTGATATACACTCTCAAATTAACACAATGCCGTGGCTGTTAGTGGGGATTTCAATGTTT
GTAGATACACATCAGAGAAAATTGCAGGAAGGAAGCTAACTGCAAGGAAACTACAAGACTTCAATGATTGTATACAGAAATGTGGAC
TGTCTGACATCAAAAGTACCGGTTCATCTTGGACATGGCATAATAAGCAACAAGGTAGATACAGAATATATGGTAAATTGGATAGGG
CCCTGAGCAACTCATATTTGATAAATAAGTTTCCTCAAGTGTTTATAGAATATAAATGCACTTCTTCTAGTGATCACACTCCAGCTC
TTGTCCATCTTATGCCCAGCACTCTTTCAGAGCCAAAGCCATTCAGATTTTTTAACTACTGGACTCAATGTCAGGGTTTTGAAGATG
TGGTCAGTAGTGTCTGGAACAATTTTAAAGCAGGTTCTCCAATGTTCAAGTTAGTTTCTAAACTTAAGGATTTAAAATCCGCTCTCA
AATTTTGGTCAAAACAGTCAGGTACTTCAACAAAGAATAATATTATAAAGCTGTCAAAGCAGTTGGAGCACATCCAGAATGAGCTAA
ATAATGACATGGAAAATGAGGACTTGCAATCTACTGAATTAGCATTATGTTTCGAGCTAGATGGATGGTTAAACAAGGGGGAGGATG
AGATGAGGCAGAAAAGTAGACAATCATGGCTACAACAAGGGGATAGAAACACTCAGTTCTTTTATAATGCTATCAAACAAAGAATAT
CTATGAATAGCATACGACATCTGATTGACAAAGAAGGCTCTCCTATCTCTTCTATTGACCAGATTAAACTAATGGCTCCAAAATTTT
ATGAAGATTTATTCAATCAAACCTCATATTGGAATATTTTTCCTAAACTGACAGTTAAGAGAATTCTAACTGAGGAAGCAAAACAAT
GGTTATGCAAGGATATAAGTTACAAGGAGATCAAGGATGCTCTTTTCCAGATGAATCCAGATAAGGCACCAGGACCTGATGGTTTTA
ACGCCTATTTTTATCAACAGAACTGGAGTTTAATCAAGAATGATGTGGCTCTGGTAGTGAAATCCTTTTTCTCATCAGGTAAACTTC
TTAAACAGATCAATCATACTTTCCTCACCCTAGTACCGAAATCACATGAAGCATCTTCCATAAATGATTATAGACCAATATCTTGTT
GCAATGTCATATACAAGATTATATCTAAAATCTTGAGTAATCGTCTTAAATTGGTGGTGGGAGAATTGATATCAAAAAATCAACATG
CTTTTCTGCAAGGGAGACATATAGGTGAATGTTCTTTATTGGCTCATGAATTGCTAAGGGATTTCTCTAAGAATCATGGGAAAAGAG
CTTGTTTTAAAATTGATTTGCATAAAGCTTTTGATAGCATTAATAGAGAGTTTGTATACTATATTATGCATTGTATGGGTTTTCCAG
TCAAATGGATCAATTGGATCAAGGAGTGCCTGTCTTCAGCAACTTTCTCAGTTCTTTTAAATGGTTCCCCTAATGGTTTTTTTCAGA
GTAATAGGGGTATTAGGCAAGGAGACCCTCTATCTCCTTATATTTTTGTATTAGTGATGGAATTCTGGTCTATTGGGATGGAGCTAG
CTACAATCTCAGGGGATATTCAAAATTTTAAGAAAAGCAAGAATCTGCAAGTTTCCCATATTTTGTTCGCTGATGATATGTTGGTTT

Fig. 13CB

TCTGTAGAGCAAATAGAAAATCTTTCGAAGGTTTAAACACTCTGTTAGATTCTCTGGTTCTCCATACTGGTCTGAGTATCAACTGAA
GCAAAAGCAGGATATTTTACAGCAGGGGTTGTGTTAATACAAATGATCTAAGCTCTATTGTGGGAATATCTAGAGGAACTCTGCCTA
TGAAATACTTGGGATTACCTCTATCAATAAATTATCCTAAAGCTAAAGATTTTATATCCCTAATTGATAAAGTTAGAAGTAAGATTG
AGGGGTGGATGACTCATACCTTATCATTTGCCGGGCAGGCTTGAGCTCATTAAAGCAGTCCTGTATAGTACCACATCTTATTGGTTCT
CTGTTTATAACTTTCCTAGCTCTGTTGTACACATTTTGGAAGCTATTTTTGCAAACTTTCTTTGGAAAGGTAAGATGCATGCTATTA
ATTGGAAAAAAGTTTGTAGACCAAAAGAAGAAGGAGGATTTGGTCTTAGAAAACTTGATGATCTCTGTCAGGCCGCAAGTTTAAAGT
TGATTTGGCAACTCCTTACTGTTAATTCTCTGTGGGCTAATTGGATGAATACAAGATATATAAAGGATGTTAATTTCTGGAATACTT
CTTCTAACTTAATGGATTCTGGCACTTGGAAGCATCTTTCAGATCTCAAAATCAAAGCTTTGAATTGCATAAGGAAATCTATTGGAA
ATGGGCAGTCTACTTCACTCTGGTTTGATCCATGGATTCAGGATGGCAGAATTATTGAATTATTATAGCATCATACTCCTCAACTCA
CTGGCACTGAGAACTGGACAGTTTCCTATATTATACAAAATTCTCAATGGAATATCACGTTACCTTGTCTTATGCCTCTGGTGAATG
TAATTACTAAAATCAAAATTTCTGGACAAAGGGATCAATGGGTTTGGCTACCTGCAGCTAGTGGTAAGTTCTCTTTTGCTTCGACTT
GGGATCTGTTAGACCCTAGAAGGGGGGGGGTGATTAGGGTCTTATGCTAATTTAATCCGATTAAATGCCAATTAAAAACTAATTAA
CAAGTTATCCTAGCAAGTATGAAATGCAACAATATATATGAACTAGGATAAGCAATATACAATATGATATATCCTAGCAAAGAGGCA
TATAGTGAAATATATGCAAGGATATATAAACTAACACAAGGGGTAAACAATCTAAACAAGATAGTGGATGATATAGATAATGAGCTA
ATGACAATGGCGATATAAGATATGAACATAAATATGAATGAACGCCAAAGCACACTCAAACAAGCAATATGATCACGGAATTTGGAC
ATTCCGTCCTACGTCTCCGCTCCCCACTCCCGGGGAGAAATCCACTAACACAATCCGGTTTGGAAGCCGGAACTTCTTCTACACACT
CGGTTTTCTAGCTAACCGAAAACTCTCACACAACAAACACTATGCAATCACACTCTACACCCACCTCAAAAGGTTGTGTGTGAACAA
AGAGATATAAATCAAAACTAAACTCAAAGTAGTTCTAGCTTAATAACAATGATAATCAAATATATAAAAGAGCTAGAAATAGAGTTT
AGAAAACTTCTCAATATATCAAGAGTGCAGGGAGAAGAGTTGGATGCACAAACGCCAATAGATGATCTCCTCAAGCTCTTGTTGAAT
TGAATCACAAAACTGAAACACTCTAATGCTTAAAAGCTTCTTAAAACAAACTTAAACAAACACTAAACAAGTTTAAACCCTTGTTAA
AAACTTTTTAAACCATTCTCTTATATATAAGAAAAGAGTGCAATGGGGGTATATATAACCTCCCAAGAACTCAGCCAAAAAACTGAG
CAAAAGACAAAACAGCCCCAAGGCAACGGTCATAAAAAGAGCCGTTGGAACTGTACTGGACAGGCGTCGGTCGACCGATCCGGTCGA
CCGAAAAAGCTCTCGGTCGACCGGACCGGTCGACCGACGAATCTCTGGAAAAATACTGACGAATGGTCAATTGACCGGTCGACCGTA
CCGGTCGACCGAAAACNNNNNNNNNNNNNNNNNNNNNNNNNNNNNNNNNNNNNNNNNNNNNNNNNNNNNNNNNNNNNNNNNNNNNNNNNNNN
NTCCAAAAACTAAGAAAACCATATTTTCACAAAATTGCATATTCTATGCAATGTTTTCAAAAACACAATAGAAAATATGAAATATAT
AATTTCATATATATAATCATAAAAACTCAAAACACATGTATGTATATATATAACTATATATATAGAAACCAAAACTTATGTATATAT
ATATAACTATATATATATACGAAGAAACCAATAAATGTGTGTGTATGCATATTGACCTTAGAGTATATAACACACATAATATAAAAT
CTAAAACTACATTACCCAAGCAATCTTGATCTTCAATAACCTTGACTTGGTACACTTGCGAATGAAGCTTGAACTTGATCTTTAACT
TGAATTGAATAAGCTTCACCGACATTCCGCCAACCTCCTTTGGATATGATCGTTGAAGCTCTATTCCATCCATCCTCCAACAACGTT
GTTTGTCTACAAAACATAGGAATTCACAAACACTAGACAAACAACATTAGTAATAAATTGTTTGTTAAACATCATCAAAACAAGTGG
TAAGTTCTCTTTTGCTTCGGCTTGGGATCAAGTTAGGACTCCCTACGATAGGTTTGAGCTTTACAATGTGATTTGGTTCCCTTCAGT
AAATCCTAAAATGGCCTGTTGTTTGATTAACTTTACAATGTGATTTGGTTCCCTTCAGTAAATCCTAAAATGGCCTGTTGTTTGATT
AAAAGTCTATACAATAGACTGGCTACTAGAGACAGGCTTTCAAAATTTGGGATCTCCTCAATGGAGGATTGTGTTCTTTGTTCTGGT
GAGAAGGAAACTAGAGACCATCTCTTCTTTCAATGCCCATTTACAGCTTTTATTTGGAAACTCTGTAAATTAAAATTGCAATTGGAT
TCTACTGTTATTCAAGATCTTAGAACTGAAGCGCTGCAAATTCAACAGAAATTCAAGGTGAAGAATAGAACATACAAACTGGCAAGA
TTGGTTTTAAGTGCTACTGTGTGGCATATCTGGCAAGAAAGAAATCGTCGAATCTTTCACAATCAAAGGATGCATAAGATTTTGGTG
TTTAGGAGACTTTATGAAGATATAAATGTTCTTCTGAGAACCTGTAATTGGAAGGCGGGAAATGAAGCTGTTCTAGCCAATTGGAGT
CTGGAACCAATTAGTCGTGAACAGTGATCTCACGTAGTGTTTTCGAGTTTTATTTGTGTAAGGGGCAGTACTATTTTTTCTCTTTTG
TTTTGGTTTTGGGTAATACTGTTTTTCCTTTAGTTTCTTTAGTTGAGGGTGACGGCCATGGTCCTCTTCCCTCTCTATAGTTTCTAA
GGTTTGATTCAGTGTCACCCAGCCAATTTATGTAAATATCTACTAGCGTTATGATATTAATGAAATACTTATCTTTCAAAAAAATATA
TATATATATATATATATATNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN

Fig. 13CC

NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNCTGACCCCT
ACATCACATCTCAAAGATAGAGCCTTAACCACCTTTCACCAACTCAAATATAGATGTAGGGTCCAGATTAGGCCACATAACTACCAA
GTTACTTGGAGAAAACTAGTACAAAGTTTCTTCATTGTAAGGACTGACCCCTACATCACATCTCAAAGATAGAGCCTTAACTATCTT
TCACCAACTCAAATATAGATGTAGGGTCCAGATTAGGCCACATAACTACCAAGTTACTTGGAGAAAACTAGTACAAAGTTTCTTCAT
TGTAAGGACCATGATTTTTTAATACCAGTTAAAATAATTTTTTAGTATTTTAAAAAATATTTAATTATTATTTTTAAAAAAGTATTT
GTATTTTCTCGATTTTCTAGGATTTTCTATGATTTAAAATCCACGTTTTATAATTATTTAAATGATTTAGATATTTTATAAATTTATT
TAGTGCAGTAAAAATTTTTGGATTAATCTGTTGTGTTGTCGATGCTATTACGTATCATATTTAATAATATGTTGTATTATTAATATT
ATTACGTATTATTTCGTATAATACTTTGTATTATTAATTACGTATTATTTGTATAATTTGTTGTATTATTTCTACTATTACACATTA
TTTGTCGTATTAGCATAACTGGCACGTTTTACTGTGTATATAATTATCCCATAATTATTTGATTTTAAATGTAAGTAAAATATATTTT
TATTATTATTTATTCTTGTTTTATTGTACAATATGTGTGTATTCCGACTATTTTGTATCAACTGTTATATTAGCACAATAGGTACGT
TTTTATTTGTAGATAATTACTTTATGATTAGTTTAATTTTTAAGTACCCGTATTTATTTATTTTAATTATTTTTGTTTCAAATACCT
AACCAAAATCCTAATTAATTTACATATAAATCCTCTTCTCTCTATCACACACAAACTCACGTTCTCTCAACTACCCCTCTCACGTTG
TCCCAATTCCTCTCTCCTCTAACTCCTCAGACCTNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNGCAGAACTTGAGCACCC
ATCCCCTCCTCCACCAGATTCCGTCCGCCCTACCTCCAGATCCACCTCCTTCCCTTTCGCCTACAGTCGCCCTCTTCAACCACACCC
CCGACCTCCTCTTCCTTCTCCTCCACGTTGCTGCCCCAAGCCCAAGCTCCTCGTCCGTGCCTCTCTCCTGCAGCTCGAGCCCCACTC
CGCCTGCACCACCTCCAGCTAACCCNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNCCATACCCTCTCTCTCCTCCCCTCCTCCACTCACCCCCGCTGCCCCCTTTGCCGAGCCGAGCACCACCA
CCCAACGCCTCCTCCTCCGCTCGCCGACGACTCGTTTGACAGCCCCTAGACCGCCATCAACCTCCGCGCAACCGCTTATCGCCGTCG
CCTCACTCGTAGACTCGCGCGTCGACGTCGAATCGTTCGACACAATCCGAGCTAAGATCCCTATCCCCGGTTGTTTAATTATTATAA
ATTTCAAATTTATCATATGTTTATTAGCAGCAAGATCCCTCTTCTCGATTGTTTACTTATTATAAATTTTAGATTTATCGTATATTT
ATTAGGAGCAAGATTTCGTTGCTCAGGTTGTTAATTACACAATTTTATACTTGTTATGAATTATCTGCATATTAATTTGTGTTATAA
TTATCTGTGTGGGATTGACTGATGATTAATATCAAATAATTTATAGTAATATGATGAGTAATACTTTCAGAAGAATTATAGTAAATT
ATGAGAATTTATTTGGCAAAAGAATTATATTTTTGATAATTATGATAATTTTAAAGGAATGATTTTGGAAAAAGAATCATTTTTGAT
AATTATGATGATTTAAAGGATTTTATTTGTAAAAAAATTATCTTATTTGTAAAAAAAAATTATCTATTTTGGATTTTAAGTAATTTA
TGATTTTGTATGAGTAGTTTACAGGGTTGGATAACAAGATATTGATAAAACCGGACTGTATGTATGTTTTTACTCTTTATGATAACA
TTTCACGTTTTGCAGTTATGTAATGTATTTGACATGTCTGCTATGTATTGTCCATGCTGTGTTTGAGAACCCTTAGTAGTTCATGAC
ATGTGTGGGTGTGTTGACTGAATTTAGGTGGTGAACCCAAGTTTCAATGAGGTTTATGGTTGATTTAGAAAGACGAGAAGAGTTGGG
ATGGGGAAGTCCATGTTCATGTGATCGGATAAGGTTGTTGATGTATCTTCCAAACTTACACCAGTGAACCGTTTCGCACTGGGGTTA
GTTTGTTAGGCCAAGTGAACTGTTTCGCACTTGGTCAGTGAAATAGTTTCGTCACCTGAGTTTTGCTTGAGTTAGAACCAGACCAAA
ATCGGATTGCGTGTAGTCCTCTCACCGAACCGTTTCGCGGGTTTAGATGCACGTAGGGGAGAACAGCCAGTTATCCGGTGATATAAG
TGTTGACTCTGTGTGAGATGTGGACCAATGACCTGTTATAGAATGACTAGTTACATGACCTTGTTACTTAAGGTGATTAGGATTCTT
GTGTGAGATGTAGGTCGGTTGTGTTTCTTTTCATACATAGATCGGGGTTAATATTTAGTTATCTACAATTTGAGACATATGATATAT
ACATGAGGGTTTCCTTATTTGGATTATTTTGCTCGACATACTACGTCTCTTGTTGTAGATTTTTAAGAATTAATTCTATCTAGTTGT
ATGACATGGTTACTTGGATGATTGCTGATTGCTAGCTGCATGATCGACTTGTTACTTAATTGATTTTGTTGAATTTTAGTTGTGCG
TTTCTTTGTCATTTCTATTGTTGTATCGTTTCTCGTATTGGGTGTTTGTACGTTCTTTCTTTTGTGGGGTCTTTTCATGTGCCATGC
ACGCTGACGTACACCTGTTTTCTCTGGTGTACGTCAGACTTAGAGGAAGAACAGGTTCAACGGGAGCCAGATGATTCTCAACAGGAG
TGCTTTGTAGACGGAGCAGAAGGAGTCGAAGCCTATTCTTTTTATTTATTAGTTGATGATTCCAGTTACTTTTGTAGTTCTTTCTGT
AGGCATATAAAATTGCTTATAGGTCCCTTAGCTCAGCTCAGCACAAACCGACAAACCAACGAGGCGACGAGATTGACTAATCGCACG
CAAGCAACGGAATACGTCCATTCGCGTGCGGGATCAAGCCAAGTGTTCGAAGAGTCAACGAGTCATCCAACCAAGAGCATACTCGGA
CGAACCACGATCGAAATCGGGATCCGGATTTACTGCCAAATCAGGTCAACAAATCGAATCCGAACCAATCAACCACAGAACCGGAAA
ACGGGCACAAAGAGGCAAAACGACAAACACCTGGAGGTCGGCTCACCGAGCCACCAAGGAGGCTCGGTGGCCGAGCCACCAAGTGGT
GGCTCGGCCGAGCCACCTAGGTGGCTCGGTGGCCGAGCCACCTTGGGGTGGCTCGGCCACCTCCGAGCCACCAAATGGTGGCTCGGA
GGCCGAGCCACCTCCTTGGTGGCTCGGCGGCCACCAAGGTGGCTCGGCCACCACCGAGCCACCAAGAGGTGGCTCANNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNGAGAGGATCA
GATCTCAGATCTACGCAGGCATACTCCGGATCTAAGCTTGGTCTTAGATCCCGAGACTTGGACGATTGTTTCCTTGGTGAAACAATC
CTCCCGGCTATTATTTCCTGGTGAAATAATACCGTCGTATTGCGTAGATCCGACCGGATCTAGATCTCGCGGTGGTCCACGGCA
AATAACCCCGGCGCAGGCAGAACCCACACAAGCGAGCGACCGCAAAACAGGAGCTCGTGATTCGTTCGACTCTTCCAAGAGAAAACT
TCGTTGGTACGAAGAAGTTGAACCTCCCAACGAAGATCTCGCCCCGTTTGATGCCGAAGCTGCATCGGGTGAGATCTCTCCTTCCAA
CCAGGTCAGATCTGCTCTGGCCGAATCTTCCGTTGCCGAGGGCGTAGTGACTCTCTCAAAGAGAGCCCGCCAAAGGCAACGTCAGCG
CCTTGCGAAACAAATCGCAAAGGCAATGGAATCTGTGGACGGGATCCGTTACAACACGGATCTGAAGAACAGAAGAGCCGAACGACC
TCAACAACCAATGAATGGCAACTCCTCCAAGCCACCAACGAACGAATGGATCCGTGTCAAACGGAACCGTTCAACGCTGGAGGATCG
CATTCAGAAGCGCCGCGCACTCTCAGCACAAGCACGAGCTCAAGTTCAAGAAGCCCGTAGAAGGTGGCAGAATGGAGTAGCCAAGAA
ATCACCACTAACTCACAAAATATGGAGGCCAAAGTCCAAAGTGGTGAGTCAGGCCGAGGATCGACCTTTACAGCCTTCAAAACGAGT
TCAACCTCCCGAACCATCCCGAGGAAGGAGGTCAATCTTGGAGCGCCTCGGTCCAATTCCCGACGAGCGCAACGAAGTCCATGAACG
CTCGGGCCCGATGAAGAGGCTCCGAACTAATCAACATGCTGGGGTCGACACAACCCTCAACATGACAAAGAGTTTACGGCACCCAA
GCGCACTACCTTGCGCATCGAAGTTCGGGAGCCCGCTGAGAATTCATGTCTACAAAGGCGTGTTTCGAGGCGAGTGACTCTCGGAAG

Fig. 13CD

TCCAAATAAGGCAGTTTGCTCTCAGAAGGAAACGTTGTCATCCGAGGATGATAACGTTATACCTGGGAAATCATGCCAACACGCGAT
AGGTTACTCCGATCAAATGGACGAGTTGTACTATCGTGCTGGGGGTACGAACAAAACAAGAAAAAGAAGCCCTCAAGGGCTCGAAAC
TCAGTGCCCATGTGCCAAGCTCATTCGGGTAGTACTGTCTCAATGCAACTGCATCAAGGGAGTCCCCGAGAGAATTTCAGTGTTCGA
AAGGCTCGGCACCGAAACGCCAAAACCAAGGCATAGGCGCTTCCGGCAAAGAAGAACAGTGGTTAAGGATGGAGAATTTCCGAAGGT
CACCGCCAACATGACCAGCAAAGAGACATCGACACAGATTGATCTCAAATCGTTTCTGGAAGCGTCCCGGCGTGTAACCCGTCTGCA
GTCCGGAGCCATCGCACGAGGAACTTATGGTAGGGTTCGGATAAGATTGCCTTCGGAAGATGAAGAATCGGATTCCTGCTCTGCTGT
CGCATCGGACAATACAGTGTCCAGCGAAGGACAACCCCGCGAGTCATTCATGATAGGCGCGGAAGAAATGGCCAAAATGCTTGAAGA
CGCTTTGGCTAAGCAGAAAGAAAGTTTTAAATTCGAGATGGAGACGGCCATGCAGCAGATGAGAGAGATGCATGAACAGCAAATCCA
AGCATTCAGGAACCAACAAGGTGAACCAAGCCACCGTAACCAGGTTGCTCAGGAAAAGGAGCACGCGGATGGGGATGAAGCTCACAA
TGCCAATAACCCTCCCATCAATGCAGGGGGTGGTAGTGAGGATGCCAACGGGGATACAAGTGAAGACTTGAAGATCAAAAGCCTCGA
GACTAAAATCAATACGTTGCTGTCTGCTCAAGAGGTAAAGAAAACGGGCATTCCTTGTCCATACCCGAGGGAATGGGAATCAATCCC
CTATCCGGCGAAGTTTAGTCTAATCAACTTCACGCCGTTCGATGGAAGGGGTTCCCCCACCCAGCATTTGATTTATTTCAAATCGCA
CCTGGGTGCTATCTCTGGGAACGAGCCTCTGATGGTGCGGTCATTCGTCGGCACTCTTCGCGGAGCTGCCTTCGATTGGTATCGTCG
CCTCAAGCCAGGAAGCGTGAACAGCTGGGATGACATGGAGACGAAGTTCCTTGCAAATTTCTTCGACGACGACACCGAGATCTCTAT
CGGATCGTTGCTCGACGAGAAACAAAAAGACGGGGAGTTAGTCGACACCTTCGTCAAAAGCTTCCGGAACAAGGCGATGAATTGCCG
GGACCCGATCACCGAGGAATTCATTCTCCAGACTTGCCACAACAACCTCGCATTGGACGTATTGGAGGCAATGGGGACAGCACCGTC
TGACACTTGGAAGGATCTGAAGGTGCGCGGTGAACAAGCCGAACGCTTCCTTAAAAGGAAGAAGGCCGAAAGGAACCAACCGACGGT
TAATCTGCTGGACTCAAACTTCGCTTCCCGTGGTAAGGGCAAAGCACCTGCAGCTGCTGGTGGTGCTAATCAAGCGTCACAACAGCA
ATCCCGAAGGCAGCAGAAGACTTCGGGTCCGAGACTCCAGAGAGAGTATTCCTTCAAGGACGAAGACGTTCCAACCATCTTCGAATC
GCTCCTCGAAGGCAACAAGATCAAGCTACCACCTATCACGAATCAGGAGGAAGCTGATAACACTACGGACCCAAAGTACTGTGCATA
CCACAGAAGGGTTGTTCATCCCACCAAGGATTGCTTTGCTCTCAGGAATAGCATTCAGACCTTGGTCGAAGCCGGCGTTATAACGCT
AAGGTAAGCCAAATAAAAACGGCAAAACTCCGACCGGTATAAGAGTATAAACTGCTTCCTGACACTCCAAAGAGTATACGAGTATAA
ACTGTTTCTCAATCCTCCGACCGGTATAAGAGGTTAAACTACTCCCTGATACTCCAATAGGTATATGAGTCTAAACTGTTTCCCCAC
TTTTGACGGGAAGTTCCTGGAGAATATTAAGCTAATATTCTTAAGGATAACCCGGTTAGTTAACTGATAATAATGTCCGAACCAGTT
CCGCAGAGGAAACTGGGGTGGACGATTTATGTAACGGGAAGTTCCCAAAACCACAGCAATGTAATGAATAAGGACTCCCATTCAAG
TTCTCACTGTGTCTGTGCACTCAACACTCTCTCTGTTAGAGTCTGGACGTAAAGTTCCTGATTGGTCAAACCTTCTTACAGTTAGGA
CCACAGTCAAAATCCCCTCTCGATTCTCCCAATGAACGAGAGGTCCACAAATCAAGCGATCAAACCTTCCTACAGTTAGGATCGTCT
TAAACCTTCCATTCGGTCAAACCTTTCTACAGTTAGGACCAAAACCAAAAACCCCTCTCGATTCCTCCAATGAACCAGAGGTCCACT
TTCAAATCGAGTGATCAAACCTTCCTACAGTTAGGGTCACCTCAAACCTCCCACTTGGTCAAACCTTCCTACAGTTAGGACCAAAAC
CACGATTCATTCTCGATAAACGAGAAATTCATCTTTAGTTCGATAATCAAACCTTCCGACAGTTAGGGTTATCCGAATCTTTTTGAT
TCTCGGAGTGGAGATCCCACTCTTAGTTTCACCTTTCCGGATTCTGGGGGTGGAGATCCCACCTCGAGTCTCCTTTCCTTCTTTGTT
CGGGGAATAGAATATAAAATTCTTCCTTCCCCATACCAATCCTTTTCGAAGAATTCAGGATTCATCCTAGGAAGTTTATCCCGAATC
CTAAGCACGGATAAGTCTGCGCCTAACACGCGCTGCCGGTTTAGTCTTTTTTCTGCACAAAAAGACACCAGAGTTCGATTCTGGGCT
ATTCTATCCTGAAACCTAAGCAAGGATAAGTCTGCGCCTGACACGCGCTGCCGGTCAGTTCTTAACCGTTTAAAAAGAACACCCGTT
CACATATTCAACATTGTGACAGGTTGTTATTAATAACACCAAAATCCATGCCTTACACGCATGGGAATTTCATCCTGAATCCTAAG
AAAGGATATGTCGACACCTAACACGTGTCGCCGGTTTAGTCTTTTACCGATTGAAAAAGACACCAGAATACCAGTCTGGGGTATTTT
TATCCCGAAGCCTAAGTAGGGATAAGTCAACGTCTAATACACGTTGCTGGGTAGCCTATTCCCATAACAATGGTAAAGCCTATGTAT
TCAACATCATAGCACAAAGTCTAAGAGAATTCACTCTCTTAGCACAACGTTACATGCGGAACGGATTTCGTCAATCCGCATGCTAGC
CCGACTCAAACGGTAGTCGGTAAAGGCTAATCAAATCCGTTAAAGGCTTGGGGTTAGCCAAAAATCCTAAAGTCAACGCCTAACACG
CGTCGCCGGGTAGTCTATTCCCGTGAGAAAGACGAAGTCTACGTATTCGAAGTCGTAGCATCAAGTCTAAGGGAGTTCATTCCTTTA
GCACAACGTCACATGCGGAACGGACTTAAGACAATCCGCATGTAAGCCCGATTCAAACGGTAATCGGTAAAAGCATGACAAATCCGT
TGAGGGCTGAGGATTTGCCAAAAATCCTAAGTCAACGTCTGATACACGTTGCTGTTTAGTCTTTTCACAGGAGAAAGACGAAGTCTA
CGTATTCAATATCGTAGCACTAAAAGAGTTAACTCTTTTAGCATAACGTCACATGCGGAACGGACTTAAACAATCCGCATGCTAGCC
CGACTCAAACGGTAGTCGGTAAAGGCTCATCAAACCCGTTAATGGCTGAGGGTTTGCCAAAAATCCTATAAATACGAGAGTCACTGA
CGCATCAGCTTCATTAGTTGGTCTCGTGACTTGAGCATCCAGCGACATTCAAAACCCTAAGGTTAACGCCGGACAACGCATAACCCT
AGGTCAACGCCAGTCAACGCGTTGCAATCAAACAGTCAACGTACGACGTCCAAAACCCTAAGGTCAACGCCGGACAACGCGTAACCC
TAGGTCAACGCCAGTCAATGCGTTGCGATCAAAAAATCAACGTACGACGTTCAAAACCCTAGGTCAACGCCGGACAACGCGTAACCC
TAGGTCAACGCCTATCAATGCGTTGCAATGAAAGAACTAACACTCCGAAGAGTATATGAGTATAAACTGCTCCTCAATCCTCCAACA
GTGCATGAGGTTAAACTGCTTCTTAATACTCCAATAAGGTATACGAGTATAAACTATTCCCTATTGTTGGTTGAGAAGTTCCTGGAG
AATATTTTCATTCTTAAGGATAACTCAACAACACTACGCCGGACAACGCGTCGCAAATAAAGACTCAACGCCGACATTCGAGGGTCA
GTTCTGTGTTCAACCAACAAGCACGAGCTAAAAATCAGAAAACCAGGAATTGACTTCAAGTTCGAATTTCCGACAACGGTCAGACAA
TAAATGCAGCACCGGAACTCTTACAGACTTTCGACAAAGCACCGAAAAGCCTGGAGAATTGAAGGAGTCAAGAACGGGAATCATTCC
AAGATCCCATTACACCGACTAAAGGTGGGGGCAATCATATCCAAAGTATTCCAGACTCTTCTATAAAAGAACGAGACTGAAATACTT
TGGAGGGGGTATCTGTAGGCATATAAAATTGCTTATAGGTCCCTTTTGCTCAGCTCGGCACAAACCGACGAACCAACGAGGCGACGA
GATCGACGAATCGCATCAAGCGACGGAATGCATCCATACACGTGCGGGATCAAGCCAACTGTTCGAAGAGTCAACGAGTCATCCAAC
CAAAGGCATACTCGGACGAATGACGATCGAATCAAGATCGGTTTCGGACTCCAACTCAGAAGCGGATTTACTGCCTAATCGGGATCC
GGATTTACTGCCAAATCAGGTCAACAAATCGAATCCGAACCTATCAACCGCAGAACCGGAAAACGGGCACAAAGAGGCAAAACGACA
GCCACCTAGGTGGCCGGCCACACTGTGCCTAAGGCACAGTGAGGGTAGCCTATAAATAGGCCACCCCCTTGTTCATTTGAGAGGGTT
GGAAATTTTGGAGAGAGCCGAAGCCCTGCTGGATTGGAGACTCGGAACTTAAAAAAAGATTGAAACTTTGGGACTTCGGGGACTCAC
TCCTTCAGATCTGGTGCTCGGCGATCATCAACGTCAAATAAGGCAGGTGTTCGAGAGGATCAGATCTCAGATCTACGCAGGCATACT

Fig. 13CE

CCGGATCTAAGCTTGGTCTTAGATCCCGAGACTTGGACGATTGTTTCCTTGGTGAAACAATCCTCCCCGGCTATTATTTCCTTGGTG
AAATAATACCCGTCGTACTGCGTAGATCCGACCGGATCTAGATCTCGCGGTGGTCCACGGCAAATAACCCCGGCGCAGGCAAAGAAC
CCACAAAGCGAGCGACCGCAAAACAGGAGCTCGCGATTCGTTCGACATAAAAGGAGAAAAGTTGTAATCTTTGTTTATTTTTATTTG
ATTTTCGTTGTAACCGGATCTTATAAAAAGACCCGATCTTTTGTTCTCTTCAGTATTCATTTGTTCAATTTGGTAAAAGGGCATTTT
GACCCAAACTTTGTGTCTTGGATTGTAGGCTGTCTAAAAATCACAATGGATGGATGATCCCCATTAAGCCCCGACAATAGATAGTTT
TGTATCTCTTCAGTATTCATTTGTTCAATTTGGTAAAAGGGCATTTTGACCCAAACTTTGTGTCTTGGATTGTAGGCTGTCTAAAAA
TCACAATGGATGGATGATCCCCATTAAGCCCCGACAATAGGAGTTACAATCAGACGACTTCCTAATTACTGTATCTGCAACCACTAT
AAACATGGCCTCATCTCTGAGATGATTGATCTTGATGCCTGCGACAACAACATGACTAATATTATATTAGCAACTATTAGAGATGCT
GATGAGCAGTGTAATGATTTCAGAAATAAAATGTTGGACTTAGTTGGTGAGTTTCTTGGTAGAGAGCTGTGGGCAAATATTCATCTA
AAAGTCACTATGGATGATTGATTCCCGTCAAGTTCCAACAATGAAAGCTACAATCAGATAGCTTTCATGCCTACAAACGAAAGCTAC
AAATGGAGAACTTTTCACATAGATCGAGAAGAGTTACAATACAACGACGCTTCCGACAACTGATGAAAACTCTATTCAGCAGTCTCC
ACAATTTACAGTGAAGGTTACAATCTGACGACTTTCACACCCTACAATAGCTAAAGCTAGGATTACTGAACAACGGTCCTTGCAACG
CTATGTAGGAGAGGTTACAAATCAATTAACCCCTTCTAAAACGCAGAAGTCATCCCCGCGTCATAATTTTGGCAATGCAGACGACCC
TCGCGTTTCCAAGCTATAACAAGCCAAACACGAGCGACCCTCGCGTTCTGGAGGTTCAACTAACACCGACCCCCGTGTTTCCAAGCT
ATAACAAGCCAAACGTGACCGACCCTCGCGTTCATTGATGTTCAGCCAACACCCAACCTCGCGTCTCAATTCTAAGAGGCGACGTTG
GGTTCTGAACGCCAGATTCGGCGTTTGACTCGCTCAAATACGAGTCGAACGGTTTCAGAACTGTTTCCCCACGATCTGAGGAAATCA
CGCCCACTTAGGAGTAGATTTAGAGGCAGTTACAACCTCTTATCCACCTATAAAAACTCAACAAACTCAACTGAGTTAAGGCTGG
CTTTTTGGAACAGAGAGGCAGCAACAGAGAGAATTCCTGAGGATCTCAACCGCATAGAGAGGCAGGAGAGGCGGATCTTTTGGAGAT
AGAGGATTTGAATTAAATTCAGAAAATCAAATCTAAGAAGATTCTTCAACAACAGAATATCTGCTTGGTCATTAACCGAATTTTCGG
TTCTAACAACTCTCTTCACAGAGTTCTAACTCGTCCAGAGTTCTTAAACTCGTTAAGAGTTACCCATCAAACTTTCCACAGAAGTTC
ATTGTTCCCACCAGATAAGAGACGGTCAGATCATCAACGAAGAGCAATTTCGACGCAAGCAATCGAAGGAGGCACTCCATCGCTACT
GAGAAGAACCCAGTTTTAAACAAAGGAGAGAACCAAATTCGTTCTCTTCTCTTTTGTAATCAAATTGTAACCGGAATCAAAGAAATA
CAAGTCAATTTTCTTTTGTTCTCTTCATTGCAATTTTTCCAACATACATGGATGATATTCATTTGTGATATGTATTATTTTATTCTG
CGTTGTTCATTATATTCTTGCTATCTGTGATCGGGAACCTGTGCCTTTGCATTGTATTTATTTTCAGATGCTTAGCGTATTGGAATG
AGAAGAAAAGAAAAGAGAAAAAAATAATAGTGTATATTTCTTCTCAATCTAATACGTCACGGGCTTGTTCACGTTACGATTCCCGGA
TATTTTGCGAAGCAGGGCCTGACAGGTGTTTTTTTGATAGCCCATGTAGGTCACGGTCCCGAGTTTCCACTAGTAAGAATATAACCG
ACAATTTAGATACATATCATGATTTCATCCGTGAGACTATTCTTGAGCCCTTATCCTATTTATTAATAGATTTTGTTTCGTCCCTA
TCTTATTCCTCTTTGACTCCGGAGTTTTCCATGGTTCTTGTTCAATCGCTTCGGGATTACCCCCTCTTTGTTGTATTGATTTAGATA
CATATTATGTGTTATTATTTTTACAATTATATTTTTTATTTGACTTATATATTGTTTAGTTGTATTGATTTCTGCATTATTTATTAC
ATTATTTTATATATCACCTATAATGTTATATTGTATGTTTTTATTAAAAATATATATCATTACTTATACACTTTCAATTGTTCAAAT
CATGTTCATTAAGTATTTTACATTACTTTAGATTCACCTATACATCGCATATCATATCTGATATTTATGTTAGACCCTAGAGCGAGC
GTGATTAGGGTCTTATGCTAATCTAATCCGATTTTATACCAATTAAAACTAATTAACAAGTTATCCTAGCAAGTATGAAATACAACA
AGATATATGAGCTAGGATAAGCAATATGAACTAAGGGATATATCCTAGTAATGAAATATGCTATGTGATAAATGTAAGGATATACAA
ATCATACAAGGCTAAGCAAACTAGACTAGATAGAGGGTTAAATAAACAATGAGCAATACACAATGGCGATATAAGATATGAGCAAGA
AAATAAGTGTGCTAAGCAATCACAAACAAACGATATGATCACGGAGTTCGGTCTAACCACTTGACCTACATCTCCGCTCCTCACCTC
AACGAGATCTCCACTATCACAATTAGGTTTTCTACGTTTACCCGAATAACGTTTACACTACACAATACGATTTTCTAGTTTACTGAA
AACTCTACAACTAACACACTCTTGTAATCCCACTCTACACCCTCTCAAGTGTTGAACTAGACGTGTCTCCCTTAAGTGCTCGGATAC
AACCTCTTCCTAGGTTCATCAACTGACGCCACTCCTCTTGGGATGATCCCCGACTCTCGTCACACACTTCTTTCGGTGTACAAGTGT
ATTACAAAGTGAATCTCACAATAAGCACAATACAAAGTGTTTGTTCTCTATAATGGATGAGAATGAATTATAAGCTCACTCTCTAAG
TTACACAATCCCACAACCCAATTATACTATGAATGTAAATACAATAAGCTCAATGGTAGAGTGTGTGTAAACAAAGAGAAAATAAAA
TCAACTAAATTCAATATGAACACTAGCTTAATAAAATGATAATCAAACAATATAAAATATAAAGCTAGATTGAGTTTAAAAAACTTC
TCAATAGATCAAGAGTGGAAGGAGAAGAGTTGGATGCTCAAACACCAATAGATGATCTCCTCAAGCTCTTGTGAAATTGATTTCACA
AACTCAAACTCTCAAATGCTTAAAAGCTTCTTAAAACAAACTTAAACAAAAACTTAAACCCTTATTAAAACTTTGTTAAAATATTTC
TTAGATTGTAACTAGTAGAAGGGGTTTGAGGGATTTATATAGGAAGAGAAACCAACAGCAAAACCCCCAACCAAATCTCCCAAAAAC
CCAGAAAAAGATTTTTCAGATTCTGTACAAAAAGAGTCGTTGGAGTAAACGACGGTCGACCGTGAAAATCTCGCGGTCGACCGCAAG
CCACTTTCGAGGCTCATAAAATTCCAGAAACTTTGACGGTCGACCGTGACAGTCGACCGTGGCAATTTTTGAGCTGACGGTCGACCG
TGGTGGTCGACCGATAAAGTTGTTGTTGGTTCGCAGGTTAAAAACAAAGGCGCGGTCGACCGTGGCGGTCGACCGTAAATTGACATA
TGAGAAAACAAGTTTGAAAGTTAATTTTCTGATTTTAAAACCCTGTTTAAAAAATCAAATAAATTCTAAAAAATATAAAACTTTGGA
AAATGATTGTAGACATGATAATAAACATGCTACAAAGACTGGTTTTTAAAAAGGACCTCCCAAATGAAAAATATCATCATTTTACAA
AATAGTCCAAAACATGAAAATGTAAACATATGAATTTTGATATTTTGGCTAAACCATGTTTTGAAACAATAAAAAATAATTTTATAG
ACTTGAAGAAAGATGTATACTATTATTATGAAGTCTATAAACAATGTGGGCACAATATAAGCACAATCAATAACTTCCCATAAGTTA
ATATTTCTAGATTCAACAAATATTTTAAATTTAGAGCACCATTGAGCATAAGGGAAATTTCTATATTTTGGAGCAATATTTGGATTA
TAGCCTAAACAAAATACATTCATATTCATGATATATATGTGAATATATGCAAGCAAGAAAAATGTAATCATAACTAGATTAGCACAA
ATAAGATAACTTGGATCTTTAACTCAAGGCGATTAGTCCTTAAATCAAAGGCACTAAGCTCTGATACTAATTGTTAGACCGTAGAC
AGGGGAGGGGTGATTAGGGTCTTATACTAATCTAATCCGATTTTATGCCAATTAAAACTAATTAACAAGTTATCCTAGCAAGTATG
AAATACAACAAGATATATGAGCTAGGATAAGCAATATGAACTAAGGGATATATCCTAGCAATGAGATATGCTATGAGATATATGCAA
GGATATACAAATCACACAAGGGTAAGCAAACTAGACTAGATAGTAGGTTAAATAAACAATGAGCAATACATAATGGCGATATAAGAT
ATGAGCAAGAAAATAAGTGCGCCAAGCAATCACAAACAAACAATATGATCACGGAGTTCGGTCTAACCACTTGACCTATGTCTCCGC
TCCTCACCTCGAGGAGATCTCCACTATCACAACGGATTTTCTACGTTTACCCGAATAACGTTTACATCACAAAATACGATTTTCTA
GTTTACCGAAAACTCTACAACTAACACACTCTTGTAATCCCACTCTATACCCTCTCAAGTGTTGAACTAGACGTGTCTCCCTCAAGT

Fig. 13CF

GCTCGGATACAACCTCTTCCTAGGTTCGTCAACCGACGCCACTCCTCTTGGGACGATCCCCGACTCTCGCCACACACTTCTCTTGGT
GTACAAGTGTTGATAATCACATTTTTGTTACAATTTTATACCCTCATTATCTATTTTATATGAATAAATATACCATTAATAATTATT
GTTAGATTAGTTTGCACATAATTGAATGAAAATATAAATAAATATTATTAAATATAAAAACCCCTCAAAAATCTCTCTTCTCTATTT
TATAGCATTTTTGAATCCCAAAGACCATCAAGAAAAATGATTACACTAAGAGTTGAAATGGACGTGGATGCAAAGAGTGGAATGATT
TGGACTTGGTTGCTAAAAAATAAATAAATAAGAGTTGAAATGGACGTGGATGCAAAGAGTGGAATGATTTGGACTTGGTTGCTAAAA
AATAAATAAATTGGACTTTTATGCAAAGCTGGACCGGACTTCTGCTGCTCTTCAAAATCAAATGGAAATTTCCATTGGGGCCGAACT
GGTGTTTGAATGAAAACAAAGCCATCAACAAATGAGCTTCATGGGCCGTTGCTACAAGTTTAATTCTCTTGTATTTTGAAAAGCAAA
TGGGAACTATATTGGGCCGGAATTGATTTTGAAGACCGGACATATGTTTACTTGCTGCAGAGTTAAAAAAAATCACATGGGCCAAAG
AAAAATCAATTGAATTCACACACATCATGGCCGGACTATTTTGCTGCAAATTTGGATTGGACCAGCTCTTCAATTTCGGTTTTTTTT
GTGAAAATCAAATGGGAACTCAATTGGGCCGGCTGCTGCATAAATGAGAACCGAACTTGTAGACCGGACTTGTGGTTTTCATTTTGG
AAAATCAACAAATAAATTGGGCCGAAAATTGATTGTTGATTTTCTTTTGAAAAAAATCATATGGGTTAAAGAAGAACCAAAAAAGCAAA
TTCAAAGGTGGAGATTGTGGCTTGGGGCTCAAGACAAATCCAATGGCTCATATTCATTGAAGATTACTATAAATAGGGGTAGAGAGT
GAGGGGTTAGAGGTGTGAAAATTTTGTAAACTCCTTTTGGAGAGGAGGCCTACTCTTAATTGAGAAGGCCTTCCAAAAAATTGTAACT
TTAGTTGCAATTAATAAAAATAATTTTTTCCTCTTTAAATTTGTTCTTTCTCCTCTTTGTTGAATGATGAGGATGGAGATGAAGAGC
AATTTGAAGGTTTCATTTCTTTTCTCTTTTATTTCTTTTTAGTAATTTCTTTATTATTGCTTATTAGTTAGATTTAAATTCATGCT
TGTAGTGTAGATTTATTTTCTTGTCTTTTTTATTTCTTTTTGCACTTTAATTTGTAGAATAGATTTATTTTCTCGCATTTAATTTTT
GTAATATATTTTGTAGTGTAGATTTTTATTTTCTTTGTACTTAGATTTATTTCTTGTTCATAGTTTAGATTTTTCTTTTCTTTTTAT
TTTTGTAATTAGTTCTTTTCTTGTTTTTATTTCTTAAAGATGTGAATTTAATTCTTGTAGGAAGTTTAGAATTATATGAAACTAGT
CTAATTTCCTTTATATTGTATGAATTATTCTCTTGCACTTAAAATGTTCATGTTTAGGATAATCAACTAGAGAACTAATCGGTAGAA
GAAGAATTTGATAATCTATGCTTATCTTAAATGGTTTGATAGGTTATGCTTATGAATTCTAGGATTATTATCATGTTGTTGTTCTTA
TCATGAATAGTAATTTTGACTTAGATGATAATTTGATAGGTTACACTTTTCTTAAATGGTTTGATAATCTATGCTTAATAAATCTAA
GTTGAAATATGATAAAAAGAGAATAGTTTATATTTTGTAATTGAAATTGGTTAGTGGATTATATTCTAGATTTCTTACCTCTTTTGA
ATCCAATTCATCTTAACTTTCTTAAATTTTCTTTTTATTTTTGGTTTTATTTTTTGATTTTATTAATTCATATTTCTTACCTTGTGA
TTTCATTTATTCTTTAATTCTTCATTCTCTCCTCTAAAATTCAATTTATTATCTTTTACATATATTCATAACAATCACTCAACAAAA
TCACACTTATTCTTTATTCCTAATTGTCACGCACAAAATATAAGAACCAAGTTTAATAATCTCTTAAAATCACCTTCTTCGTGGAT
CGATATCTTTTTATACTATAACTTGATAAATTGTGCACTTGCAATTTTGGTACATAATTATGCCGCATCAAGTTTTTGGCGCCGTTG
CCGGGAAGGTGCTAAAATAGGATTTTATTAACTTGATTCTTTAACTTGTGTATTTTTCTTGTGAAGGAACCGCTTGCAGCTTGAAA
ATCTTGGATTCAAGATCAAGAATTTGGAGCATTGCTTTCGGGTAAGTCTTCTTTCTAGTTTCAATTCCACCCTCTTTAGCTAGCTT
CACAATTAGAGACAATTAGGATTTAAAAAAAAAAGATTTTATTTTTGTTGACCATAATAAAATCCATCTTTCACTTAGATATTAACT
AACAAGATAATAAACTCAAACAATTTTCCCCTTCTCACTTTTGATTATTGTTGACCATAATTAAAAAATATAAAGATTTTCTTTTTA
CCATCCTTTTTAGTCGCTTTTAATTTCTAGGGTTGCATTTCATATAGTGTAGGAATTCACCAAAGTGATTGTAGCACTTGATTTGGC
ACACACTTAAATCATTCTTAAGGGCAAAACCCCAATCAAGATAAGGTAAGGGATTTCATCACCCTTTCCTTAGCCCACAAATCACTA
ATTCCTCACTTCACAAATCCAAGCCTTCTAAAACTCATTAGACGTTGGCCCCTAAGGATTCGAGCTCAATAAGGAACAAGAAATCCT
TAAGTGAACGGTTTAAGTTTTCTCAGAATAGTTGGTGTCTAAGGCAAGGTTTAGGGGTTGCGTAAAGCGCTCCGCAAGGAAAGAGGT
ACTTAATTGATCTTTGATCACCCTCTAGTACTATCCTTACCTTGCTAACTACTTGGGTAAAACTTTGATCTTTTCACTGTAGGAATT
TTTTGGTTAGGAGCTGGTCTAGTGGAGTTAGGCTAAACCCTAGGGTTAGAGTTGATTGAAAAGTGATTGCCTTGATTTGTTTTAGTT
AGGAATTTTTCTTTTTCTTTATCTTCTCATATAAAAAAAAAACTAATTTTTCTTTTGTTTCTTAAAAAAAAATTTAATTTTCTTAAA
ATAAAAAAAAAACTAATTTTCTTTCTTTCTTTAAAAAAAAAAAAAAAACTTGTTTTGGTGTATGCAATTTTGGGTTCGGGATAATTT
TCATCGCTTAATCCGTGTTGAACCAATCCAAAAAATGGCAAATCAGCCCGTTCTTCAGGATATGTGTTACCCCACCAGAAATGCAAT
TCCATCTTGCATAAGACTCCCCGAAGTAAATGGAGCAAATTTCGAACTTAGACCGTATTTCATTAACATGCTTCCCAAATTCCTAGG
TAATGAAACAGAAGATGCATATATATTTATCTCGGAATTTGAGGAAGTATGTATTATGATAAAAATGAGAGAATTAACCGAAGATGC
GATTAAGCTTAGATTTATTCCATTTGCCCTTAAGGACAAAGCTAAAAAATAGATGTACAGCTTACCGATAAATTCCATCCCATCTCA
ACTTGGGAGGAATTTGTCACCGTTTTTCTCAAGAAATTTTTCCCTATTCACAAAACGGTAAAGCTTAGGAACAACATTCAGAATTTT
AAAATTGTCCCGGCAGAGCCATTCTGGAAATACTTTGACCGATTTAAAGATCTTTTAATCCAATGTCCTCATCACGGTCTAGAAAAA
TGACGATTGTGCCAAGTCATATATGAAGGATTGGACTATTCTTCAAAAACATCTTTAGAATCGATGTGTCAGGGAGACTTTATGAAA
AAAAACGCCGATGAAGCTTGGGAATTCCTAGAGAGTCTATCTGAGAAAACAATGCAGTGGGAAAATTGTGATGACAGGGTTTCATCT
GTTTTCCAATCTAAGTCTAGTGGTTTTTCCTTGGAGTCAAACATTGCGTCTGGAGCGAAGATGGCGACGATTATGCGGAGGTTAGAA
GCCTTAGAAGTTAAGGAACGAGCTCCGGCTCAAATCAATCACATTTCTGCCCCAGGATGTCATAACTGTCAGTCTCCTACCCACGTT
TCAGAGGAATGTCCTCTTCTAGGAAACAACCATGCTTTAGAACAGATGAACGCTGCATTCCAGCGCCCTAGAAATGATCCATTTTCT
CCAACCTACAATCCAGGTTGGAGAAATCATCCCAATTTTGCTTGGAACCAAGGAAATTCTCATGGAAACCAAAACTTTATTCCCCGG
TCAAACCAACAATTCCCTAGGGGAAACACTGTCCCATTCAACGCACCGAACAATTTTTCTAACCCACCTTTTCCAAACCAACATCCT
CATCCTCACCAGCCTACAAATCAATCAAATTCCGATCATGACAAACGTTTGAGTGTCTTAGAAAAGGGTTTAGAAGCTATGATCAAA
GCTTCTACACAAACTACCAACATGTTGACCCAACTATGATCAAAGCTTCTACACAAACCACCAACATGTTGACTCAATCATCCACCA
CTCTAAATTCCTTCATGCAAACTACCGGCCAAGTGCTCAACTCGAACACTCAAGCCATAGCCCGGTTAGAAACCCAACTTGGGCAAT
TAGCCGCTGCCGTGAGTGAGAGAGAAAAAGGAAAATTCCCAAGTCAACCTGTTGCAAACCCTAAAGAAACCGGATCCAGTTCCAATA
ATCCAGCTCCACTGAATGCAATTCACACTCTGAGATCAGGAAAACAAATAGACAATCAGGTTAGAATGCCACCGGATCAAACCCCTT
CTCCCATTCAAAACACTCCTTCCGACGAAACAATTCCTTCCGATGACCAAAATGCTGAACTTGAGATTGAGCCTGATCTAGATAGGT
ATAGGCCCGTTGCCCCCTTTCCAGATAGACTCAAACCTAGGAAAAACTCCCCGCAGGTTGAGAAAATCCTAGAAACATTCAAACAGG
TCAAGATCAACATCCCTCTCCTAGATGCAATCGAACAAATTCCCTCTTATGCAAAGTTCTTGAAGGACTTATGCACTAAGAAAAGAA
CCACCAATGTCCCCAAGAAAGTCTTCTTAGCTGCCAACCTCAGTGAAATCTTTTCGAAACCAATGCCGTTAAAATATAAGGAACCTG

Fig. 13CG

GTTGTCCCACAATTCCATGCGTCATAGGTAACACTCACATTGATAAGGCACTTTCTAGACTTGGGAGCCAGTGTCAACCTCCTTCCTT
ATTCAGTCTATCAACAGCTAGGTGTAGGAGAACTTAAACCGACAAGATGCACTCTACAGTTAGCTGATAGATCTGTAAAAATTCCCA
AAGGAGAGGTAGAGGATGTTCTGATCAAAGTTGGAGAGTTCATTTTCCCTGTTGATTTTATTGTCTTGGAAACGCAGCCCGTTTCCA
ATCTCAAAAGTCAAATCCCCGTCATTCTAGGAAGACCGTTCTTAGCCACCTCAAATGCTTTGATAAACTGTAGAACCGGTCAGATGA
AACTATCTTTTGGGAATATGACTGTTGACCTCAATATCTTCAACTTAGGGAGACAGCCTAGTGATCCATCTGATGAACCCATGGAAG
TGAATTTCATTCAAGGAATATCCAGTGAACAACAACAGCGACAGTGTGACTCTGATTCAAATGCATCTGATTTAATGATTGAGGAGC
TTTCTGATGACGAACTAGAGATAGAACCACTGATCAATCATGTTTTTGCTGTTGGCTAGCAATGAGAACCTTTGGAGATAGAACCCC
GAGTCCAGCTTCGCCCATCTGTGGAGGAACCCCCTAAGTTAGAGCTCAAACCTCTACCCGAAAATCTAGAGTATGCCTACTTAGGGG
AGAACGAGTCTTTACCAGTTATCATTTCTTCTGAGTTGACTACCGGTCAAAACGAAGCTCTCTTAGCTGTTTTAAGAGAGAATAGGG
AAGCCATTGGATGGACCATGGCTGATATCAAAGGGATTAGTCCAACCATTGTTCAACACCGAATCCATTTGATAGATGATGCCAAAC
CTACTAGAGATGCTCAACGTAGGTTAAACCCAGTGATGAAAGAAGCAGTTAGGAAAGATATTCTGAAATGTCTCGATCATGGGATCA
TTTATCCCATTTCTGATAGTTCATGGGTGAGTCCAGTCCAAGTTGTTCCAAAGAAATCTGGGATCACCGTGATCCAAAATGAGGCTA
ATGAGCTGATTCCCACTCGAATCCAAACCGGATGGCGAGTTTGCATTGACTACCGAAAGCTCAACTTAGCCACTCAGAAAGATCACT
TCCCCCTTCCTTTCATTGACCAAATGTTAAAGCGTTTAGCAGGACACGAGTTCTACTGTTTCCTGGATGGATATTCAGGTTACAATC
AAATCCCTATCGCTCCAGAAGATCAGGAGAAAACCACCTTCACTTGCCCGTATGGAACATTCGCATACCGACGCATGCCTTTTGGCC
TGTGCAATGCACCGGCCACATTCCAACGTTGCATGATCAGTATTTTTTCCGACATGGTAGAGCGATTTCTCGAAATTTTCATGGATG
ACTTTTCCATTTTTGGTGACACATTTTCCCAATGTTTGCATCATCTTAAACTGGTCCTAGAACGGTGTAGGCAGAAAAATCTGACTC
TCAATTGGGAGAAATGTCATTTCATGGTCAAACAAGGCATTGTCTTAGGACATGTAGTTTCCAATAGGGGAATCGAAGTGGACAAAG
CTAAGGTAGATCTCATTTCCAATCTCCCTCCTCCCAAAACTGTCAAAGATGTCAGATCGTTTCTTGGTCATGCTGGTTTTTACCGAC
GTTTCATCAAGGATTTCAGCAAAATTGCTAGACCCTTGACCAATCTTTTAGCCAAGGATACATCATTTGTCTTCTCCCCCGACTGCC
TCAAAGCTTTCGAATATCTGAAAAAGGAGCTAACCACAGCTCCTATCATTCATGCACCAGACTGGACCTTACCATTTGAACTGATGT
GTGATGCATCTGATTCTGCAATCGGTGCTGTTTTAGGACAACGGTTTGATGGAAAACCGCATGTGATCTACTACGCCAGTAGGACTC
TGAATGATGCCCAGCAAAACTACTCTGTCACAGAGAAAGAGTTTTTAGCTGTAGTCTTTGCCTTAGAAAAATTCAGGTCCTACCTCA
TCGGTTCCTTAACCAAAGTTTTCACAGATCATGCCGCACTAAAGTATCTTTTGACCAAAAAGGATGCTAAAGCACGGCTCATTAGAT
GGATTCTCCTTCTTCAAGAGTTTGACATTCAAATTCTTGACAGAAGGGGAACAGAGAACCCCGTAGCAGATCACCTCTCTCGACTCC
CAAATGCACCAACATCAACCGTTCCAATCAATGAACATTTTCCAGATGAACAACTCCTAGAAATCCAATCTGTTCCCTGGTTCGCCG
ACATTGTGAACTACATAGTCATGAACCAGATCCCTTCTCATTGGTCCAAACAGGATAGATCCCGTTTTCTCTCCCAAGTAAAATACT
TTTACTGGGATGATCCATATCTGTTCAAATACTGTCCTGATCAGATCTTTAGGCAGGTGTGTTCCCACTGAAGAAACTAGGACTGTTA
TATCCTTTTGTCATGAGCAAGCATGTGGGGGCCACTTTGGCCCAAGAAAAACAATTTCTGTAACCGTTCTTTCGAGGCTTTGATGAG
GAAATATTCAATCACACACAAATTGTCAACTCCTTATCACCCCCAAACCAGTGGACAAGTAGAGGTCACAAACAGGCAGATCAAACA
AATCTTAGAAAAAACAGTTAATCATAACAGAAAAGATTGGTCTGTAAAATTGTGTGATGCTCTGTGGGCATATAGAACAGCTTTTAA
GGCCAATTTGGGGATGTCACCATACAGATTAATATTCGGCAAAGCCTGTCACCTACCAGTGGAGTTGGAGCATCGAGCAATGTGGGC
GATTAAACAGTTAAATTTTGACTCAGACTCGGCAGGGAAGAACAGATTGCTCCAAATAAATGAGTTGGAAGAAATTAGAAATGATGC
ATACATAAACTCAAAAATTTACAAAGAGAACAAAAATTTTTCATGACAAATCAATTTTGCGAAAAAATTTCTCTCCAGGACAGAAAG
TTTTATTGTACAATTCGAAATTGCATCTTTTTTCGGGAAAATTAAGATCAAGATGGACTGGTCCATTTTTTGTTAAACAAGTTTTTC
CACATGGAGCTGTCGAGATAGAAAACCCTAAAAATGGTAATATTTTTAAAATAAATGGTCAACGTCTAAAACCATTTTTAGAATTTT
CTACGCTCGGAGAGGAAGAGGTGTTGGTTCTTCATGAACCTCATTATCTATAATAATAATAATAATAATAATAAAACAAACAAAAAA
AAATTTGAATAAGTAACATAAAAAACAACCGAACAACTGTAAGTTCTTCAATTTTATCTGCTTTACTTTGTGCTTCAGCGAATTTGC
ATTGAGGACAATGCAAAATTTAGGTGTGGGGTGAGAAATACATATTTTCCTCTTTATTTTACCTTTTTAGTTGCATTTTTCTTTCT
TTTTGTTAAAAAAAAAAATATATAAAAATATTGTCACTTGCCAAATTAATCAACCGAACAACTGTAAGTTCTTCAATTTTATCTGCT
TTACTTTGTGCTTCAGCGAATTTGCATTGAGGACAATGCAAAATTTAGGTGTGGGGTGAGAAATACATATTTTCCTCTTTATTTTA
CCTTTTTAGTTGCATTTTTCTTTCTTTTTGTTAAAAAAAAAAATATATAAAAATATTGTCACTTGCCAAATTAATAGAGTTAAGTAA
TAATTGATCAAATTGATAGATTTTAAATTTTCTAATTCTTAGTTAGTGACATATTCAAGTTCACCTTTTATGATAACTCCAAATAAA
ATTCTTAAGAAATGATTTTTCAACTAGTATACTTTACTTAAGTCTTACCTTAGATTTTTAATTAAAAACAATGAAATTTTTGCATGC
TTAACTTAGAGTTGAAAATATTTTTTTCAAGTTATCTTGATTTACACAATTTTTTAAAGACTATATATACTTATACATATATATTAA
AAAAAACTAACCTTATAAAAGAAGAGTGCGAAAAATGGGCACCACCAAAAAAAAAAAAACCTCTTAAATTCAAGGTGATTCTATCT
TATAAAGCCTAAGTTGACTGAGCAATTAAGCCCAAGGAGTATCTCTATACTTAATGACCTAAGCCCAATTGGGTTGGGATTCATTGG
CCCAAAACTCGTTAAATGGTCACTTAGAAAGCCCGTTAAAATAGAAAACAATCACCAAGAATTAGAGAGTAGAAAAAATATACATAT
ATATAACACTAACAATTGTTTTTATATATTGTTGTTTTGTATATATGGTCTTGAAAAATAATTTTTGATCAAGAGACTTGAAAGTTA
TTTAAAACAAAGAGTTGGCATGTTCTTTTCAAAACTTTTTAATTAAATTTCTAAGATTTGACTTGGTTTTGTATTGCTATAATGAAA
AAGATTTTCTAGGGGATTTACATTGGAGTTATATATAAAAACGTTTTCTTGATTATTAACTAGCTTCAATTAGAATGTTTAAATATA
TCAAGGAAAATCTGTTATTTACTGACTTATTTAACTTGGCAAGTTGACCGAATTTTGTGGGTATATTCACTGCAAACCCTCACGAGA
CTACAACTCGTCCACTAGGGTAACCTAGGGGTTTAAAGGCTTGTTGTATACGCTAAATACAACCGCGATTCCTGCGAAAGTGAGTTA
GGATTTTCTTTTTATTCTCTTTGCTAGAGGACTAGCAAAAGTTTAGGTATGGGGGTATTTGATAATCACATTTTGTTACAATTTTAT
ACCCTCATTATCTATTTTATATGAATAAATATACCATTAATAATTATTGTTAGATTAGTTTGCACATAATTGAATGAAAATATAAAT
AAATATTATTAAATATAAAAACCCCTCAAAAATCTCTCTTCTCTATTTTATAGCATTTTTGAAGCCCAAAGACCATCAAGAAAAATA
ATTACACCAAGAGTTGAAATGGACGTGGATGCAAAGAGTGGAATGATTTGGACTTGGTTGCTAAAAAATAAATAAATAAGAGTTGAA
ATGGACGTGGATGCAAAGAGTGGAATGATTTGGACTTGGTTGCTAAAAAATAAATAAATTGGACTTTTATGCAAAGCTGGACCGGAC
TTCTGCTGCTCTTCAAAATCAAATGGAAATTTCCATTGGGGCCGAACTGGTGTTTGAATGAAAACAAAGCCATCAACAAATGAGCTT
CATGGGCCGTTGCTACAAGTTTAATTCTCTTGTATTTTGAAAAGCAAATGGGAACTATATTGGGCCGGAATTGATTTTGAAGACCGG

Fig. 13CH

ACATATGTTTACTTGCTGCAGAGTTAAAAAAAATCACATGGCCCAAAGAAAAATCAATTGAATTCACACACATCATGGCCGGACTAT
TTTGCTGCAAATTTGGATTGGACCAACTCTTCAATTTCGGTTTTTTTTGTGAAAATCAAATGGGAACTCAATTGGGCCGGCTGCTGC
ATAAATGAGAACCGAACTTGTAGACCAGACTTGTGGTTTTCATTTTGGAAAATCAACAAATAAATTGGCCGAAAATTGATTGTTGA
TTTTCTTTTGAAAAAATCATATGGGTTAAAGAAGAACCAAAAAGCAAATTCAAAGGTGGAGATTGTGGCTTGGGGCTCAAGACAAAT
CCAAGGGCTCATATTCATTGAAGATTACTATAAATAGGGGTAGAGAGTGAGGGGTTAGAGAGTGAAAATTTTGTAAACTCCTTTTGG
AGAGGAGGGCTACTCTTAATTGAGAAGGCCTTCCAAAAATTGTAACTTTAGTTGCAATTAATAAAAATAATTTTTTCCTCTTTAAAT
TTGTACTTTCTCCTCTTGTTGAATGATGAGGATGGAGATGAAGAGCAATTTGAAGCTTTGCATTTCTTTTCTCTTTTATTTCTTTTT
AGTAATTTCTTTATTATTGCTTATTAGTTAGATTTAAATTCATGCTTGTAGTATAGAATTACTTTCTTGTCTTTTTTATTTTCTTTT
TGCACTTTAATTTGTAGACTAGATTTATTTTTCTTGCATTTAATTTCTGCAATTTATTTTGTAGTTTAGATTTTTATTTTCTTTGTA
ATTAGATTTATTTCTTGTTCATAGTTTAGATTTTTCTTTTCTTTTTAATTTTGTAATTAGTCTTCTTTTTCTTGTTTTTATTTCTTA
AGATGTGAATTTAATTCTTGTAGGAATCTTAGAATTGTATGAAACTAGTCTAATTTCTTTTATATTGTATGAATTATTCTCTTGTAC
TTAAAATGTTCATGTTAGGATAATCAACTAGAGAACTAATCGGTAGAAGAAGAATTTGATAATCTATGCTTATCTTAAATGGTTTGA
TAGGTTATGCTTATGAATTCTAGGATTATTATCATGTTGTTGTTCTTATCATGAATAGTAATTTCTTATTCTTTATTCCTAATTGTC
ACGCATAAAATATAAGAACCAAGTTTAATAATCTCTTAAAATCACCTTCTTCGTGGGATCGATATCTTTTTATACTATAACTTGATA
AATTGTGCACTTGTAATTTTTGGTACATAATTATGCACCATCAAGTTTTTAAAATCACCTTCTCTCCTCTTGGGACGATCCCCGACT
CTCGCCACACACTTCTCTTGGTGTACAAGTGTATTATAAAGTGAATCTCACAATAAGCACAATACAAAGTGTTTGTTCTCTACAATG
GATGAGAACGAATTATAAGCTCACTCTCTAAGTTACACAATTTCACAACCTAATTATACTATGAATATAAATACAATAAGCTCAATG
GTTGTGTGTGTGTAAACAAAGAGAAAATAAAATCAACTAAATTCAATATGAACACTAGCTTAATAAAATAATAATCAAACAATATAA
AATATAAAGCTAGATTGAGTTTAGAAAACTTCTCAATATATCAAGAGTGGCTTCTGAGTGATACGAGTCACCGTGCCAGCACTCTTG
ATCGCGGAATTATCAAGAGTGGGTAGAGAAGAAAACGACAGAAGAACACAAGAGTATAATTAGGGCGAAGGAAAATACCTTCTCTAG
ATTATGAGAATCAATTGGATTTACAAAATTTCTCTCTCACAATCTATCTAGATCAAAGAACAACATCCCTGATCTCTTTTCTGATTA
CAATCTGAGTGATAAACCCTAGAAAAGTCATGTTTCTATTTATACTAAACAGAAATCCTAAACGGTGCAGGAAAACAGGCCCAGGCC
CATAACCGCTACGCGGTCGACCGCTGAGACCAAGTCGGTCGAACGGCCAGAACATCGTTTTCTAGAAAAATCAATTACAGTGTTTCA
GATCGACCGTAGCGCCTCCATCGGTCGACCGCTCTCAGTCTCGAGACACAGTCTAGGTCTGTGCACTACGCGGTCGACCGCTGTGAC
CAAGTCGGTCGACCGGCCAGAGCCCAGTTGTATTTCCTGCAGTTTGACGAATCCTTCGACTTCGCCACCTCCAATGACCTCGTCCAC
GACTCCTTTACTCTATTCTCAAGATACCATGAGAATCATCTATCCTCAAGCTCCCATGAGGATCGCTAAGCTCCCGAAAAGAAGATA
CACCCATATCGGTCCCTCCTTTAGGAACTTGAAGTCCCATTCAAGTTAGAACTTCAGCTGAGGGAACTTGCGAGCCCCTCCTTCTCT
GTTGAACCACTTAGCCTTGCTAGGAACCTCACCTTGACGTTCAATGAGAAACGACTGCTTCGTGCCCCCGTCTCATCGTCGTTGCCTT
CCGTTCCAAAATGCAATCTTCTTTCAGTGGCTCCTCTCTATCAAACCACAAGTCTTCAACATGCGGTAAGATCATCTTGTCATCACC
TTCATCATCCAATAATGGAGGCTCAAACAACTTCAAGTACTCGACATTGATCACCGAATACATGCCTAAGTAAGGCGGCAAATCTAA
TCGAAAAGCGTTGTCGCCAATCTGATCGAGAATCCGAAACGGACCATAACGAATAGGCTTCAACTTCTTCCCTTCTCCTTTTAGCCT
CTCCTTACTCAGTTTTAACCATACCATATCGCCTTTACCAAAGTTACAAGGAACCCGATGTTGATCATGCTTCGCCTTGTACTTAGC
TTGTGATTTCTTCAATTGAGCTTCAACCGTGGCATGAATATGTGCAATCTTCTCGAGAAATCGCTGAGCACATTGTCTTTCACTCCC
CTCTTTGTCGTCCACCGTGGCTTCACACGAAAACACAAGATCGAACGGGCTCGGCGGTAAAAATCCATAACAAGTCTCAAATGGTGA
CTTTTCGGAAGATCCATGAATCGCCCGATTAAAAGCAAACTGTAAATATGGTAAACTCTCATCCCAAGTCTTAGGATGCCTGGAATT
ATAGCCCCGTAACATTTGCACCATAGTCCGGTTGACTACCTCCGTTTGTCCGTCTGTTTGTGGATGAAAGGCCGTGCTCTTCTTCAA
TTTAGTGTCCATCAAACTCCACAAAGAATCCTAAAAATGCCCAAGAAAACGGCTATTCCGATCCGAAATAATCGAACTCGGCAACCC
AAACTGCTTCCACACATGCTCAAAGAATAATTGTGCTACACCCGCTCCCGTCACGGTCTTCTTACAAGGAATCAATATCACCATCTT
GCTAAACCGGTCCACCACAACGTATAAATAGTCATGCCCGCTGTAGGCATATAAAATTGCTTATAGGTCCCTTAGCACAGCTCGGCA
CAAACCGACGAACCAACGA

>lcl|scaffold3098
GAAAGAGAGAGAAGGAAGAGAGAGAGAGAAATGAGCTGGGTACGAAATGAGAGAGGGGCTGGGTTTAAATAGATAAAAAAAATGAATAA
AATAATAAAAATAAAATATTGAGTGAGATACGCGTGCAGCAGTCATTTTTGAAAAAATGCCGACGGAGAGAACGGGGTTGTTGGGGT
TTGTCACGGGAGCAAAATAATCTTGAAGTATTTTCAAATAGTTTCAGGTATTTAAACGAAAAATAATTAAAATAAATAATTTCGGGT
ACTTAAAAATTAAACTAATTACATAATAATTATCTATAAATAAAAACGTACATTTTGAGCTAATACAACAGTTGATATGAAACTGTC
AAAAATATACCCGTATTGTACAATTAAACGGAAATAATTAATAATAAAAATATTTACTTACATTTAAAATCAAATAATTATGTGACA
ATTATCTACACGATAAAACGTACCAGTTATGCTAATACGACAGCTGATACGTAATAATACAATAATTTACACAAATAATACGTAATT
AATAATTCAATATAATACAAGAATTAATACGTAATAGTAATAATAATACGACGTATTATTTAAAATAATACGTAATAGTATCAGTAA
TACAACAGATAAATCCCATAATTTTTTATTGCACTAAATTAATTTATAAATATAAAAACCATTTAAATAAATATAAAACTTAGACTT
TAAATCATAGAAAATTCTAGAAAATCGAGAAAAAATACAAATACTCTTTTAAAAATCATAATTAAATATTTTAAAATACCAAAAATTT
ATTTAACTAGTATCAAAATTTTACGGTCATTACATTGCTCCTCCCTGACGAAACCCGAGTCAATAAGCTTTTTGACTTCGGACTCG
ATTGCCTCCATGATTTGTGGACGAAATCGTCTTTGTTGTTGTTTGACGGGTTTGACATCCGGTTTAATATTGAGACAATGCACTACT
ACATTTGGATCGAGACCTGGCATATCTTCATAATTCCAAGCGAACACATCGATGTATTCCCTAATGAGAGAGATTAGTTCTTCTTTC
TCATTTGGTGGGAGGTTGTCGCTAATGAATATTGGCTTCGGATTTTCCTCGCTTCCCATATTCACTTGGACCACTTGATCCTCGGTA
GGAGGTTCTCTTTGTTCAAACCTATCACCGTATTGCATATTCAAGTGATGAACCCAAAGGTCCTCCCAAGTTGGCATTTGATCGTCT
TCCTCTATTGTAGCAGGATCAACCGTAGTCTTGTTCACCATTAGCCTTTTAAACATTTCTCCGAGACTGGCGTCGGAGTCCCAGGCT
GAAGAGTCGGAAGAATATCCATTTTTGCCCTTATTAGCGATCTGGTCGATGACCTGCCAGCAACATTCGTCATCGGACGAGGAGACA
TAACCTAAACCCCTTCTGTGGCGATAATAATCATCAGGTTTTCCTTTTGATACATAGGCCATTCGGGGCGGAACTCGCGGACCTCGA
CCAAAGCAAAGACCTTCTCCTAGCGTGAAATCATATCCATACTTCTCCATGAGATCGCGCGCTTTCGTGTTATACCTAAATAGATGA

Fig. 13CI

GGGGCAGGTTTATCATCATTGTCTTCCTCTTCCAAGAAGTGGTCGGGTATCGGAGATTCTCTTCCTTTACCGTAGACGACTTCCTTT
TCACCTCTTGTACCTGCTTTTTCGTCATGCAAAATGATTAAAGTGGCATATACAAGTCAGGTTATCATATAATTCTTTAGTGATAT
TATCAAGACACATCGAGTACTCTAAATCATCGTTTATTGATAGTTCTTCGGCAAGTTTCCAGTTACAACTACTTTCCGATGATTCTT
CATCATCAAGATTGATTATAATGGGTACAATGTCATTAAGTACAAAACCACCATCATAATCGAACCTAGCTTCGGTATCAGCTTCGT
CCCCGCTGTCCGTTCCTTGGGCCGATGGTTCAGTGTCGGATTCGGCACCGTATAGAAGGGAGTCGGTAAAATAGTTCTCCAATCCCT
TAAACGGTTGCTTATCCGCGACCACCGTCTTGACTTCGTTATTCGTGTCCACATATTTGAGGCACTGATGAAGACTTGACAGGACTA
TAAGATTACCGTGGATCCAGGATCGACCCAACAGTAAGTTATAGGATGTTTCCGCGTCAATCACGTAGAATGTAACTTCTGACTTCA
AATCCCCTATCTGGCACTTCACTCGAATTTTTCCTAGTGGTCTGGACCCACTGGTATTGAATCCGTAGATCGTAGTGTCTGTGGAGG
CTAACTTACTAGCCGGTATTCCGAGATTGTACATCAATCGAAGTGGCATGATGCTGACAGCGGAACCCGGATCGACTTGGATCCGGT
TAACAACGCTGGAGCCGATGTGACCGGTAAAATACAAGGGTCGATCATGCTTTGAATTCTTTATCTGTATGTCTTCTTTTGTGAAGG
AAATACAAGGAAAACCGTGTGCCGCGAGGTTACAATGTTGGACTGGCGGCTCCGGTTCTTCGGATGACGGCTTGACCTGAGTCAGAA
AAACTTCAGAATTAGCCAAGGCTTTTTGTAATGCTTCCCTGATATCTTTCGATAGACGTAATAGCTCATATAGAGTTATTCTAGCAG
GTATATTGGCTAACTGCGTCATAATATCGAAATGAGGTGGAGCGCTTGAACTTCCCGGTTTGTCTCTCCCAATCGGTAGATTGAATC
GAGACTGCTTCGGGTTCTGACCCTCTTGGTATAAGAGTTCTTTCCCTTTTTGCTTTTGTTGGGTTTTCTCTGCAACTGCGGGTGTTG
GAGGAGTTGCGACAATTCCCATCTCTGCTAATGTCTTAGAGGGAACGGTTTTGGTTACCCCCTGTTTAGCTAACTGTTCGGAAGCAT
CCGGATACTTGAAGTGATACTCATTTCCACTCCGGGTCACGAAGACTTCTTGTTCATCTTCGAAAAGCGGGAAAGCTGGGATTCTTT
CGTCATCTTCTCCTCGAATAGCAGAGGCTCCATAGCAGGACTTTCCTTTTCCTTTTGACTTTCTCTTGGAAGACGCATCCGGTCCACT
GTTCATCTTCAATCAAGTCGGGGTGAACCCAGAGAACTTCGCCATTCGGGGCCGTGTGTGGCACAAGTCCCTTCTGACGTTGTTTAT
AAGGATCATCGTTCACGGTGTTCATTGCAACTTTCATCACAGGTTCGGGCTGAAACCAGTTCAACGGGACAGATCCGAAGCTAATCG
ACACTGCATTCGCACCCACTTTCTTCTCTTTAGGCTGCTTCATAGTGATGACTCCTACATCAATCAAAGCTTGGATCTTATCTTNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNGGAAT
TTCGGTTCCGAAGCCTTCTGTTTCTGAGGCTGTTGTTGCCATCGTGACTGCTGAGGCGCCTTCTGCTGCTGTTGCTGCGGTTGCGCT
TCCACTTCGAATGTTTGGTTCGCATCCACTGCATTCACTTGCGCTTTCCCTTTACCCTTAGGAACAAAATTCTGTTGCGGGGCTGGT
GCCGCCGTTTGACCTCTTTCGGCCTTTTTCCTCTTGAGGAAATGTTCGGCTCTTTCCCCTCGGACCTTCAAATCTTTCCAGGTCTTA
GACGGTGCCATTCCCATGGCTTCGAGAATATCCAATGAAAGGTTGTTATGACAAGTCTCCAGGTTGAAATCCTCACTGATCGGATCC
CTACAATTCATGGTTTTGTTCCAGAATCGTTTAATGAAATTCTCCACCAACTCTCCGTCCTTTTGCTTCTCATCAAATAATGTTCCG
ATCGAGACCTCAGTCTCGTTGTCGAAGAAATTTGTGAGAAACATGTCCTCCATGTCATCCCAACTACTAATGCTCCCCGGTTTGAGG
CGGCGATACCAATCGAAGGCTGCTCCGCGGAGACTGCCGACGAATGACCGTACCATCAAAGGTTCATTCCCGGAGATTATCCCTAAG
TGAGACTTGAAGTATATTAAGTGCTGAGTGGGGAGTACTTTCCATCGAACGGTGTGAAGTTGATTAAGTTAAACTTCGCCGGATAC
GGGATTAACTCCCACTCTCTTGGATATGGCACGGTATTCCGGACCTTTTCACTTCCTGAGCATTCATCAACGCATTGATTTTGCTC
TCCAAATCTCTCATTTTCTTATCCTCACTCGTATCTGTCTTCGAGTGATTTCGGGGAGAAGTAACGTGGTCCTCATTCGTATTGTTA
TCATCCGAGGGACCATCCCCATTATTGTTGTTGACGGGAGGGGTGTTCATGTTGGCATTATCCTCTTCTCGCTCGTTATCATCTTGG
TTCGGATTATTGCGACGGCTAGACTCTCCTTGATGAGTTATCAATGCCGCGATTTGCTGGTCATGCATCTCCCTCATTCGCTGCATA
GCCATTTCCATTTCATATTTAAAACTGTCTTTTTGCTTGGTTAAAGCGTCCTCAAGAATCTTAGTCACTTGCTCGGCGCTAATCATG
ACTGATTCGTAGGGTTGTCCTGCACTTGATGTGGTGTCATCGGAAGCCATCACTGAGCAAGCATCCGAGAAAGCATCCGAGGTTTCA
TCATCCGAAGGCAGTCCCTTCTGCATTCTTTGGTAATCCCTTCGTCTACTGGTCCCCGATCGCAATCGAGTTATACGCTGGGATACT
GCGGCAAACTGATCCGGACTAAAGTGTCGCCTTGACTTTCCTCTCCCGGTCATGTTAACAGATACTTTTGGAAATTCATCATCATGG
AGAGCAGCTCTCTTCTTTCGGAAACGTCTTGGTCTGGATTCGGACATTTTGGTAGAGATTCTTTCAAACACTGAAACTCTCTCGGG
GTGGTCTTGGAATAGCAACATTCTGACAACACTGCCTTGATGATTTTGGCACATGGACAGTGAGAACCTGTGTCCCGGGCACTCATT
TTCCTGGATTTGTTCGCACCCCCAGCTTGATAGTACAACTCGTCAGTTTGATGACTGGAGCAACCTATCGTGTGTTGCCACGACTTC
CCAGGTATAACCTCTTCGTCTGACGAGTACGTTTTCTTCTGGGGATACAACGCTTCGTTAGCATTTTCAGGAGTCGCATGTCTGAGG
TGACGTTTTTGTGAATGTCGGCCCTCAACAGGCTCCTGAATTTCAACACGCAGTCCAATGCGGTCATTTGCGGGACTTTTCCCGTTA
TACATTCTCCTCCACTGCTTAGGATGACGACCTCCAGCCTGACAATGTGCTCGAGATTCATTCAATCGGCCTAACTGCTCTTTGACC
GGAGCTTTGCCTCGATCATCGGTGAGGGAACAAGGCGATCTTTGATGGTCATCTTAAAATGAGACAAATCCACACTGTCACAAATC
TCAACCGGAGGTGCCGAAACTCGATGGAATTGAAGAAATAGGTGCAGGACATCTTCTGCCTTGAATCTGTTGCGGGTCAGACTTGGGT
GACCCGCAAGTTGGAAGGTCGGATTTGGACGACCCGCAGACTGGAAGGTCGGATTGAAGTGACCCGCGTTTTGGCGGGTCGGATTGG
AGTGACCCGTGTTTTGGCGGGTCGGATTGGAGTGACCTGCGTTTCGGCGGGTCGGATTGAAGTGACCCGCGCTTTGGCGGGTCGGAT
TGAAGTGGGTCGGATTGAAGTGACCTGCAAATTGGCAGGTCGGATTGGAGTGACCCGCGTTTTTTGATCTTTTTGGCCGCCGTCTTA
GACTTTGGCCTCCATACTTGGTGCAGTCTTTGTGGCTTATTTTCCACTCTTTCTTTCTCCAATTTCTTAGCTTCTTGCATAAGAATT
TTTGCTTGTGCAAACAATACGCGGCGTTTCTGAATCCGCTCTTGAAGAGTCGATCGGTCCTTTTGACGCGAACCCATTTGTTCTTC
GCTGGTTTGAAAGAGGAGGGGCTGCCCACTCTCTGTTGTGGTGGTTGGCGCCTCCTAGATTTCAGATCCGCTTCATAACAGATTCCA
TCAACCGGTTCCAAGGCTTTAGCCAGTTGGCGGGCGAGGCGTTGGCGTCGGCCTCTGACGTGCTCTCTTTGATAGAGTGGGCACATCA
TCAACAGTTGACCCCTTACTCAAGGGGTTCAGATTTGTAGTTTTAGCCTCGTCGGATGCCGGCGAGGCGTTGTGAGCCACGGGTGCA
GCGCTGGCGGGAAGATCTTCTTGGGCTTCCCCAGCTGAAGTCCAACGGGTCTTCCTGGAGTAGGCCTTCCTGCCTCTGCGAGGAGAG
GCCGATCTGGAGGAGGAGGACAAGTATTCCTCGTACTTCTGCTGGTCGAACTCATATTCGGCCTCCGTTTCAACCGGGATCGGATC
CGAGGTTGCGATACGTCAGCCTTCGCAGAAAGGCTGTCGGCTCCCACTGTGGTCGCCAGTTTGTTTCCGTCGAAAGTTACCTTAGTC
ATTGATTTTATTAAACTTTAAACGTTACAAATGAATTCAAATAACAAAAGAATAAAAGATTACAACTTTCTTGAAAATAAACACAAG
ATCCGTTTATCGGCTCTTGCTTGCGTGGGTTCTTTGCCGGTGTCGGGGTTAATCGGTGGACGACCGCGAATCAGATCCGGTTGTAGG
AAAATTCGGCAGAGCTTCGCCTTAGCCGAGGAAGTTTTCTGGTTTGAAGCGTTGAGATCGACAAAGCAAAATCAGGGCTCTTCTTGA

Fig. 13CJ

GATTAAGACCAAGCCTAATCTCAACGAACGGACGTACGGGCTTCGAATCCTTCGAACGGCTTCTCCTTTGCTCCGAAGTTCGCCGGG
ATCTCGTTGACCTTCGCTGAAATTCCGTGCTCCTTCACTCTTCAATCCAGCAGCACCTCGTCCTCTTGATAAAATTCCAGCCCTCGA
AAATGGAGGCCTTTGGCTCGTATTTATAGCCCCCGGATACGGTTATTTTGGATCAAAACAAGTGATTTGGCTCTATCTTCAGTTAAC
AACAGCCTAACCACGTTTGGGGATGATATCAAGTCAGTTAGGAACCCCTGAAACAGATAAGTCCTGCGAAAACAGCATTAAAAACCG
TCAAAACGCATTTCAGGATCAGAACTGCGCGGCGCAGGTCGGACAGATCCGACCCGCGCTTGCGCCGGGTCGGACCAATCTGTGCGGG
TCGGATTGTTCCGTCCCGTACTTGCGCGGGTCGGCTTGTTCCGTCCTGCGCTCGCGCAGGTTTGCCGATTTTTCCTTCTTTTCCGTT
CTCTTTCTTCCGGGACTTGTCCTTTCGCGTGTTTGGTTCGCTTTGTTGACTTGTATGCTTTGCCCGCAAGACCGATTGTCGAACACGC
GTTGGTTAATATACGCGTATTGATCGATGCGCGCGGACTGATTGGCGTGCGCGCGTTGACCGACGCGTACGAGCTGGTTGACGCGTA
CGCGTTTGACCGACGCGCACGAGATGATTTGTCGTGCGCGCGCTGACCGACGTGCACGAGATGATTTGACGTACGCGCGTTGACCGG
CGCGTACGAGCTGCTTAGGTGAGCCTTCTTGACTCGCCAATTCATTGCTTTGAGTTTCGTGCGGGCTCTCATAGGCAATTTTAGACG
CCTACATTCATAAGTTAAGAATTTAATCGTATTTCTAGTTGTGTGACTGTGCAGGAAATTTGTAAAATGCTGAGAGTCACCCATGAG
GGAACGTCTCAGGTAAAGAAGGCCAAACTTACTATGTTAGTAAGCAAGTACGAAACTTCTAGATGAAGACACTAGAGGCTCTTCAAG
ATATGTTCATTAGATTCACCGATATCGCGAACAAAATGAAAGCACTTGGAAAAGAGTACCCACAAGGATGAACTTATTCGCAAGTGT
AGCAACCCTATTCACAGTTTCTGTTGTAGTTATCCTTTTGTGATTGTTTATCTTGTTTAATTTTTTTTTCCTTTATATTTGCTACAT
TTTTTGTTAACTTAACGACAAAATTTTTAATTTGTTGAAAAAGTGTAGCAACCCTATTAATCCCCCTCTAGGATTGCATCTAGATCC
TAACATACTCTTCCTATTAGAACTGCACGTATGCATGCAGACGGTTCTGATAGTATGAGTACTCCTACTAAACCCACTTTTAGCTTG
AGAAATTAATTCATTGGTTAATTAACTTGACGAGGCCTTCAGCCTCCTAACTTTCAATATTATTTTTTTAAAGAAAAAGAAAAAGTCC
TACTTTTGATACTTTTTAAAAGAAAAGGTTAATTTTAGACCTCCTCAACTATGGGCTTGTCTTAGAAAACTCTTCTCAGCTATTT
TATATTTAGAAAAACTCCCTCAAATTTGAGGATGTTGTAGATAACTCATCTTAACTTTTAAAATATGACTAAACCCCTAAACTATGG
GGTGTCTTACAAAATCACCTTGATCTTTCTAGTTTTTTCAAATAACCCTCCTAATATTATTAATTTAAAATATGTAATGACTAAAAT
ACCCTTGGTTGAAAAAAAATCATGTGAGTTAAAAAACCCAACCCAATCAAAATACTAGACTTTAGTTCAATTGGTTTGATGAGGAA
ACTCATCTTCAAAAAAAGTAAAAGTTTTAATTATTTCAAGCATTACAAGCATGAATAAGCAAAAAATAGAAGAAGTTTAGTGTTTCA
AAAAAGAAAGAAAAAATTAAATTTGCACGTGAACCTAAAAATAGAGATGGAGGAATAAGAAGAGGGGAGATATAGAATGAAAGTTAT
TTTTAATTAAAAAAAGATAAAAAGGAACACTATGGCAAAAAAATGTCTTAGGGATAGTATGATTGTTTTAAATCATTTATCCCATTA
GATTTTAATTATATTAGTTTAGGAGGTTAAGTGAGAAAAGTTGAGTGGGATAGATCATATTCTGAAAGCTAAGTGGGGTTATCTAC
AACAATTCCATAATTGAGGGGGTTTCTAGAGTTAAAATAGTTGAAAAGGGTTTTTCCAAGACGACCCCCCGTATTTGAGGAGGGTTT
TCTAAGATTAATTAACCCCAAAGAAAATCTCAAAGTTCGACTTTATTTTCCAAGAACACACATGAACTTTGGATAAAATTTCAAAAG
TCCATAAATCATCAGGGGTAAGCTGAAAAATTACAAGCATCTGGAATTTGGTGATGAGCCCAAAAACTGATGAATAGCTGAAATTTG
GTGATAAGCATCTATTTTCCCAATGCCACCCAATCCATATTCTGACTCCGACATTAAATGCAAGAAGAAACCAGAGAAACTGATGAA
TAGCTGAAATTTACAGCATCTGCACACTGGTACTTTAAAAAAAAACAACACAACAGATGTCGGAGATTTCATACTAATTGAAGGACA
AAATACTACCGTATCTTCTCACTTGAGTTTGAAATCAACATAGGGTATAAATATGAGATGGGCAAAATTGCATGGAGAAGCCTTGGT
GTGATCAAAGTATTGTGCGCTCGTGAGTGTCCTTTGCACTTGATGACAAGCCAAAGAGCCCGTGACCCTAAGCAAAATGCATGCTCT
GTACTGATCTCTTTCGCTTCATCTTTGATCTTTTCTTTGGACTCTAGCTCCTTACAATCAAAGCTCGTGTGAACTACACTTCAATAA
ACTCTCCTTTGCCGCAATTTTAATAAATTCGTTTTGGGTTTTTCCGTGTATTGAACTACACTTCAATACACGGATCCTATATATGGC
CTTTCGCCTAGCTTTCTCATGTTTTTAGCTCGTTGAATATGTTCACGGGCATACAAGTTCAAATCGATCAACGCTTGAATCTACGCA
AGTGAACAGTTCTCCCACTACATTTTTAGTTTGGCGTCTAGTGATTGTAGGTAACAACCATAGTCATTATAGATAGATTGCGGATCT
GAGTGATACCCCATCCTTTGTCCTCACAAAAAAAAAAATCCGACTTATACTTAAATCTATACAATTCACCTAGCTTTCAACGTTTCT
TAATCTTTTTACAGAGGACAAATTTTCAAAACCGTCCTATATGGACATTTAATCCCAAAAACAGAGCATTTTCCATAATATTTTCAA
AAATCGACCTGCTTTCAGCCTTGGCGCTGAAACCAGGTTGTTTTTTGTGAAAAAACTTCCGAAACTTCACAGGAGTTGAACTCCCGT
GAAGTTTAGTAAAGCTGCTAAACTTCACAGGAGTTCGTGAGGTTTCATAGTTCAAAAAAGTTTTTTAAACTATGAAACTTCACGAGA
CTTGAACTCCTCTGAAGTTTAGTAGCTTTACTAAACTTCACGGGAGTTCAACTCCCGTGAAGTCTCAGGAATTTTTTTACAAAAACC
GACCTGGTTTCAGCGCCAACGCTGAAACCAGGTCAGTTTTTAAAAATATTATAAAAAGGGGTCTGTTTTTGGGATTAAATGTGGAAA
GAGATTGTTTTTGAAAATTTGTCGTTTTATAGATGATTTAGGTTACCTGAATTACACATGATATCTCGTTAAGTTACAAGAGGAAAT
TTCACATAACCCCTGTTTGTGGAAAATTTGTAGTAAAAAGACAATGAAGGAAAATTGATCTGTATTCTTTTAATCTCAATTACAATT
GGATTTCCTGATTACAAAAGAGAAGAGAATGATCTGGATTCTCCCCTTTGTTTAATTCTGGGTTCTTCACGGTGGCGATGAGATGCC
TCCCTCGAATGCTCGCGTCGAGTTTGCTTCTCGTTGACGATCCGACATCTTGTTTCACTGGAACATGATCTTCTCCTCACGATTTGA
CGTTGTGGATAACTCTGAACGAGTTTGAAACTCTATGAAAGAGTTGATTTGAACCGAGAATCGGTTCTCAAGCCAAGGATGAAGAAG
CTCTTGTTGTAGATCTCCCAAGCTCCAGAAATGCTCTAAGGATCCTGTTGACGAGCCAAGAAGTTCTAACCGACCGNNNNNNNNNN
NNNNNTTGAACGCAGCATCTGGAAGTGCGTTCTGCAGCGATATGGAGCTGCGTTCTTCGATGTTTGAAGGTGCGTTTCGCAGTGTTA
TGGAACTGCGTCTGGCGGTGATTAAAGCTGCGTCTGGCAGCGGTATAGAGCCGCGTTGGGCATCGATTGGAGCTGCGTTGGGCAGTG
GTATAGAGCTGCATTGGGCAGCGATTGGAGCTGCGTTGGGCAGCGGTATAGAGCTGCGTTGGGCAGCGGTATAGAGCTGCGTTGGGC
AGCGATTGGAGCTGCGTTGGGCAGCGGTATAGAGCTGCGTTGGGTAGCGATTGGAGCTGCGTTGGACAGCGATTGGAGCTGCGTTTG
AGCTGCGTTCGTGGCTATGAACGTGGCGCATCTTGATGCTGGTACGCGGGGAGGACTTCCACGTCTTGATTTGAAGAGACCATCGAT
TTGTAGTCTCTTTCTGTCAGAGCGTTGCAAAGATCGTCGTTTTGTAATCTTTGCTTTAGCTCTTTGATATGTGAGAGTCGTCAGATT
ATAACTCTCGATGTTGATTGTGAAGGCTGTTGATTAGAGCTTTCATCAGTTGTTGCGAAGGTCGTCAGATTGTAACCTTCATCGATC
CACGTGAAAGTCTTCAAATTGTAGCCTTCTGAAAGTCGTCAGATTGTAACTTCCATCATCGGTGTTTGATGGGGATCAGCTATCTAT
TGTGATTTTTAGACAGCCTACAACCCCCTATCTTGGGAAGTTACATGAATGACGGGATTATTACAATGTCGCTTAACCTCCCTAACT
TTTAAGTGGGTCACCAAACACCCCAAAGGTTTGCAAGTTCAACATATACCTCATAACTTTCGACGTTATTCTGAGGAAAAAACCCAA
ACCTTCAACATCGATCATTTTCAGAAAAGCCAAAACTTCAACACTATTTCACAAAGCTCTCATGAGTGTTAAAATATAGTTTCAGAA
AAACCCCATTATGCTGTTGGTGGGGGGTATAGTGAAAAAACTGTAAACATTTGATGGTTTTTGTCATAACCAAAAAGTTACATGGAT

Fig. 13CK

TGAGTGACATTTTCAAAGTTTGGGGGTTAATCCGACAACAGTCCAAAAGATTGGGGCGTTATGTGAAATTTAAGTAGAGGGCATTAA
AGGTGTTTGCGTCGAAAGTTGTTTTCATTACTGAATCCATTACACGTTTATCAATTACAGATTCAAAGTAAAATTAGTCTTTTTATA
AGACTTTCTTACACAATAAAAATAAAAAAAATACAACTCTCTTCAAACACACGCAGATAACGTTTATCATATGCTGCTTGCGTGAGA
TCTTTGCTTGTGCTGAGGTTTATCCGTGGACCACCGCGGATCAGATCTGCTTGATCGGAATAAAAGATCAATGCTCTTGCTTCACAA
AGGAAACAATCGCAGAAGTAAATAATCTTGACCAAGCGAGATTACGACTATTCTCGAGATCAAAACCAAGTTTGATCCGGAGGAAAG
GGGAATGAGCATCAGATCTCTCGAACTTTCCCTTTTTATTCTGAAGAACTTCGTCAAGATCTGCTAGCCCTCTATGAAATTCGTCAGA
ACCTCGTCCTAGCTCTTCTAAAATTCGTGGCTCCCTTCAGATCTACCTTTATGAGTGTACTAGGAGTGTATTTATAGATTTTAAATA
TCGTATTTGTGGATAGGATCGAAGAACAACCGTTATTATCCGTTTATGTGGGTTTTCGGTTGTGTAACAGCTCCCACACGTTTAAGG
ATAACCTCACATGTTTATGGATGACCCCAAAGAGTTCTAGAAACCAATCTTATCAGAAAACATGTTGGGAGCTGACCTGGGCGCGAG
TCACTTCGAAGTGATTCGGAATTTCCGAGTCACTTTGAGGTGACTCGGATTCTCCGAGATAGTTTATACTGTCTCGGGTATTTTGGT
TTTAATTCTCTCGTCCGATCTTGGAATGAAGTGATTCAAGATGCGTTGGAAATCTGACGAATAGAGCTACAACTTTTGTCTGTTAAG
ATTTTTCGGATTCAAATATCATCATGGTTAAAATTTCAATTCTTCGTACGGGTCACTCTAGAGTGACCCGCACATGTGCAAGCCACC
TTAAGCCCTCCTGATTATATTTGCTTCGTCATTTCATACGTTTCGACGTTTCACGTGCGTTCCTTCGCTTCTTTTTACAGCATTGGA
TGATCCTCTTTGACTTGGATAATCCTCTCTAGCTCGGATAATAGAGTTCATCGCATTCTCTCCTTTTCGAACTACCTGCGGGAACCT
ATAGATAATTTTTAATGCCTATAAAAGGGTATGAAAACTTTCTAACATCATCATCTTCTTCTTCTTATTTATTATTATAAATATTTG
TTTAATGGAACTCGCATCTATTTCTATCATGTAGTACCTAGTCTATATGTAGCTAAACAATACTTCTGTGATAGGATTCATTCAACT
TAATTGCAAATATTTTTGAGCTAGAGGTAGCCTAAATAATTCTCCTGCAAAATCTACTTGATTTCATCCAAATCCAAGATACCTACG
GATATAGTAAGAAGTACAAATTTTCATGCATAGTCCATGTTAACTGTTCTGTGATACTTTTATGACAAACACTAGACGCCTATTTCC
CTTCATCCTGTACCCATTTTGTTTCAGAATCCCCAATTCATAAGAGGCAGTTTTCCTTATAATTTTCAACTATATGTCAATCTGCAG
TAGAACAAGCTTTTAACTTTAGACACCAGAAAAAATAATGAATGAGAAGCATTTAACTTATCATTTACAAACAAACTTAGGTATCGGT
TTCCTCCCCATTGCCACAAAATATACAATGGTAGCATCTGGTGCCGTTGAAGTATCAACTATAGTGTTGTTTGACATCAAACATGCG
TCAATGCGTAGCAACTAATGAATGTTAAGTTCATAACATCCTTAAGTCATATTTCAATGGTAGCGCTAACTTATATCGTCTCTTAAA
GAGTTACTGACAATTAAAGAAGATCTGCAGTGTAACACTCAAAGCGTATATTTACAATTTGGATTACCAGGGGCTTCTCAAAAGAAG
AAGAAAAATTGACTACCTTGGACTATACTTCACAAACTACTGAGATGTGGCTTATTTCATGGTTCCATCCGTGTGCAACAAACTTTG
GTCGTGCAGTGCATAATACATGATAAGTTATACATAAATGAATACAGAAATGAATAGAGAAATGAATACAGAAATGGACTGGCCTCA
ATATCCTCTACTAACAGGCAATACAAAAGTAACCTCCAAGATCATATAAAATTATCTTGATTCCTTTAGCATTTTTTATCATCGAAA
GCAATACGGACATTCTCTTGAATTCCTGGGAAACAGGGTTAATTGTTCACTTTCTTTTCAGCTCTCTATTTCTATGAGCACGCAACT
CTTCGCTATCTTTCAAGATAATTGGAAGATGTTGGATGTGACAACGGGGCAAACATTCAAGAAGAATGCAGTTCACTTACAACTTCAT
TAAAAGACCCAACACTAATGTCCAGAAAATCTGTATCAAAATGCCCCCTATCGAATTCCCCGAATGTGTGCTCAGATCAATAGAATT
GTCTGCTTGTGTATGAGCTTTCCCCACAAGATCACAGTACCTCCCCAAATACAGCTGAATTAGAATACCCATAGGAACTTTATTTAA
AACCATTAAAATGTTGTTATATCCTTTGAGATGAGACTGTCAAATTCAATATAATGGCAAGGTAATGCTAGTGCTTTGAAATTATT
GTCCCTCCTTAAGGAAACTTAATATGCTTCTACAAGTGCAGAGCAGTCACATATCATTTTCCAGTTACTTTCAGTTCTACACGTACC
CAATTTACTATTCGTCGTTGCTTTCTATTAGATATTTTTATTACACATTCTTGGAACAAGGGTCATATACTGATATTAAGGCGTAAC
CTTGCACTATGCCATATACTTGTCCCAATTTGAATATAATCACAAATGGTATGGCTGTTTCTAGCAACATAAACACTAAAGTTGAAA
TGAACCTAGCATATTGTGATCTGTCAAGTCTCACCTATGATTGAAAAACACTTCCTCTATTACTTCTGGTATGAATCTCCTCCTGCA
AGTCGCTGACAGTAGCCTGCAAATCCAAAAAAAAAAAAATCAGACGAAACCCAAAACTGACCCTAGATCTAGGAGACCAACCGAAAGA
GAGGAAACAAGCTACAAAAGAGAAAATCCAAGTCAGATCTAGGGTTTCGATGGAAGGGGAGAGAGAGGAGTAAGGGGAGACCGAA
ACCCTAGATCAGATCTAGGGTTTCAACGAGAGAGGAGAAGGGGAGAGATCGTAGAGATACCTGTTGCTGCGTTGAGAGAGAGAGATT
CGAGATCGCGAGAGGAGGAGGCGGGATCGGTCGGAGCTGAGAAACGAGGAGAGGAGGAGTCGGGATCGTCGGAGCTGAGAAACGAG
AGAGGAGTTCGGGATCGGGGTTTGGTAAATGACAAGGGGCAGGGTGGGATTTCAAATACGGGCTTTTGGGCTTTCAAATTCTCCCTT
TAAAATAATTTGATTTGAAATTCCAGCCCAGTTTTGTAGCCCAAACTAAGGATTTGGATTTGAAATACCTTGGATTTAAAATCCAGC
GTCCAAATCCATGTTCCCAAACACAATATAATTCTATGGAAATCAGGTGACATGAGTTGCATATTTTGATGATTATATGAAACCTTG
GAGCTGTAGAATGTCTTAGATGATCAGATCTATATATACCTGTCAATTAAACGGCTAATATGCTTTTCATTTTGATATTGCTACTTC
GTTTTCTAGAACACTCAAAATTGAAAGAATTTCTAGAGTTAAGTAGCGTGAACTGTACTTTATAGAACCCTCCCTCTGTTGCAAGAG
ATAAGTTTGTTCGTCCTTTATTGCAATTTCAGTCGATTGGATAATGACATTTCAAGGACGATGGTGAGCAACCAAATATTTCGGAGT
TAAAGATTGTTTCTCTAGTGATTACAGTGTAGAAGAATGAGCGTCAAAACATTAAAAATTGAAATTTTTATTCCAACGATAATATGT
TGACTTGATAATTATGTTTCGCAAGAACAGTAAATTGGAAGTAGTGTTTGGATCTCTACCAAGTTGAACATGAAATTGAGACACCAC
AGCTTTTAAGTTGTTAAGACTTGTTTAATATTTGAAACAATTAAAGGCCGTATTTTTTTTTTTTTTTTGAGAAAAAAGATGAGAGAT
CCCCTAGTGTTTCATTAAAAAGAGTTTAATAAAACATATAGATATAAAAATGGGGTTTTTGTTTTTAGGCCCAATTGTTTACTCCAC
TTTATTTTAAACCCACCTACTATTATTTGTATCTTTAAACCCAATTCTCTTTTGGTATTTGTCTTTAAACCCAATCTCCAAAATAC
AATACTTTTAGTACTTGTATTTATACAAAATCAAGGTAAAAACCCCAAAATACCCCTTTCCCCATATAAACCACTATATCTCTTCAT
CTTCCCCTTTTCAACTCAGCCCTAAATTAAAAGACGAAAGCTCCTTGCCGCCGTCGCCCGTCTCCAGCCACCGTCGCCCTCTCAGAG
CACCCTCCTTTCGTCAGTCCACAGCGTCATCCCAAGAGGACCTGACCCCAAACAATGAATCTCAACGCTCTCCTCCCCCAAAGTCTC
ATCATGAACTCTCTCCTCTATCCAAACCCTAACCATAGCCCTAATTTCACCAAAACCTCTCCTTTAAAACAGTCCAACCTCTCAAGC
TCAACCCATTGGATCTCTCTCAGCCCTCATACTCCCCGAATCGGCCTCTCGCTCAACCGGCGGGCTCGACCTCGAGGTCCGCTCTC
TACTCAGAGAGGATTGATTTGACTGCAATTAGATTCGGATCCTCCGAATCCGGCGGTGTTGACGTCGTATCGGAGCTCCGATATCCC
GAGACCGAAGCAGATAGTGTTGGAGGCCTAGGCTAGGGTTTGCACGGGACCGGAGCAGACGAAGCCGATGACCGAGGAGCAGGCAAT
GGCGGTCCTTGAGACGATTCTTAGATCAGGTGACCTCAGTTCTTTTAAGAGCTCTTACTAATTTTTCTTAAATTGAGGTCAACTTAG
TAGTTCAACTTAATTATCTTCTTATTTTTTTGGTAATTTCTGCTTATTTATGTTCGCAAATGATAACTGGGAACTTTGAGATTAGGC
ATCGAAATATGTATATAATTGGAGCATAGTATTAGAGTGCAGATGAGATTAAAATACAAAAACTGTAAGTTTATTTATTTATTTATT

Fig. 13CL

TATTATTTTTTTGGGAACTATGTGGAACAATTTATTTGAAGTCAGAGAAAGAGATATTGATGGTAATCTGAATTTGTTGCCTAGAGT
CATTGTGGACTTTACTTACTGGATATAGTTCACCCTTGTCCCTTGTCTTCGCAGTTTTGGGGCATTTTGTGGCATACTTTAACTGTG
TGTACACTATATTTAAACTGAAAGATGTTTGCATATTTTGGAAAAATTGTTCTACTAGATATTTCTAGCTGCAAAATGCATCTCTTG
CATTATAGAAAATTGACTGTTTGCCACTTCTTACATCCTTTATTTCTCAAAGAATAAATATGATCTATCACTTTCAACTGAAAGGTA
ATATCCAACAGGATGTAGTCCATGGGTAACTGTAATCTTAACTTTCTTTGTTTTTTTAGAGATGCATTAATGAAAATAACCCATCG
AGTGTGGATCGAATGTTTAAGCCAATGACGACAACTCAATTCCAAAAACTTGATAAGATTATTTTTCCACTCCTAACTTCATTTCAT
TGGCATATGTTGGTATTCTTTGTAAAGGATAGAAGATTTTATCATTATTCTTTTCTTCGCGGTATATGCCTGATGCTTGTGAGTTT
AGAGTGAATCTTATTTCTACCATTCCCGATGCTTGGAATTTAGACATTACTTCTTGTCAGGAGGTAAAAAGTGTTGATGTACCTCAA
CAACGTGGGTTAGTGTATTTGACTTATTCATATGTTGTTGTTTTTCGTATGTGCTAACACATAGAGACTATATATTGTGGGCCAAGA
GTGTTATATTGATATTGTAAACATTTGAACTTGCAGTAGCTTGGATTGCGGGATGTTCTTGATGGCATACATGTTTAGCCTCGTTTC
CGGCCAACCAATTTCAATTGACCAAAAGGATTGTGCAAGACATAGAGCTCGTATTGTTGCTCTATTTCAATCTAAAGGTATATTTTC
TATAAGTGTAATGTTCATTGAACCGCTTATATTCAGTCTATTGTTCTTTTGATCCGCTTATATTTTGCTTTCAGGAAATCAACGTGA
TCCCCAAGACTAATTCCACGGATGCTAGATGCTATCAAGCATTTTTTGTGTACATATATATGTTTGGATGATTTGTAAAGTATTTGT
ATAAATATATGTTGATTATGTAGTCCATAGTGTTTTGTGTCTTTTGTGGTAGATTATAGCCATTGTGGTTAAATTACTGGGTTATGT
AAAGTTTTGCATGCTTCTAAGTCATTGATATTGATGGTTAAATTTATTTAGACAATAACCATTGTTTGCGTGTTGTATGTGCTGGA
ATGGTTGAAGAAACTTCTTGATTTTTTTGTGTCTCTTGGATATGCAATGTTTTCTTGGATATGCAGTGTTTTGTGTCTCCTGGATAT
GCAATGTTGTATATTGTTTGCATGTTGTATTGTTTGGAAATGGATTAAGTATAGCACGTTATGTATATAGTTTGTCAATCTCCTGGA
TATGCAATGTTGTATTTTCTTGGATATGCAATGTTTGGTGTCTCTTGGATATGCAATGTTTTCTTGGATATGCAGTGTTTTGTGTCT
CCTGGATATGCAATGTTTTATATTGTTTGCATGTTGTATTGTCTAGAAATGGATTAAGTATAGCACGTTATATTGTAAGTATAGCAC
GTTAACCTGAAAATATAGCACGTTAATCTGAAAGTATAGCACGTTGTATTGTAAGTATAGCACGTTATGGAGTAAGTATAGCACGTT
AAATTGTAAGTATAACACGTTATATTATAAGTATAGCACGTTAACATGAAAATATATCACGTTAACCTGAAAGTATAGCATGTTATG
GAGTAAGTATAGCACGTTAATATGAAAGTATATCACGTTATATTGAAAGTATAGCACGTTATGAAGTAAGTATAGCACACTATGAAG
TAAGTATAGCACGTTATATTGTAAGTATAGCGCGTTAACATTTAAGTATAGCACGTTAACCTGAAAGTATAGCATGTTATGGAGTAA
GTATAGCACGTTATATTAAAAGTATAACACATTATGAAGTAAGTATAGCATGTTATATTGTAAGTATAGCACGTTAACCTGTAAGTA
TAGCACGTTGACCTGTAAGTATAGCACGTTAACCTGTAAGTATAGCACGTTGACCTGTAAGTATAGCACGTTAACATGTAAGTATAG
CACGTTAAATTGTAATCATAGCATGTTAAATTGTAAGTATAGCATGTTAAATTATAAGTATAGCACATTATATCGTAAGTATAGCAC
GTTAACCTGTAAGTATAGCACGTTAATCTGTAAGTATAGCACGTTAACATGTAAGTATAGCACGTTAAATTGTAATTATAGCACGTT
AAATTGTAAGTATAGCGCGTTAAATTGCAAGTATAACACGTTATATCGTAAGTATAGCATGTTAACATGTAAGTATAGCACGTTAAA
TTGTAAGTATAGCACGTTAAATTATAAGTATAACACGTTATATCGTAAGTATAACACGTTATATCGTAAATATAGCACGTTAACATG
TAAGTATAGCACGTTGACCTGTAAGTATAGCATGTTAACCTGTAAGTATAGCACGTTAAATTATAAGTATAGCACGTTATATCGTAA
GTATAGCACGTTAACATGCAAGTATAGCACGTTAAATTGTAAGTATAGCATGTTAAATTGTAAGTATAACACGTTATATCATAAGTA
TAGCACGTTAACCTGTAAGTATATCTTGTTAAATTGTAAGTATAGCACGTTAATTATAAGTATAGCATGTTATATCGTAAGTATAGC
ATGTTAACCTGTAAGTATAGCACGTTGACCTGTAAGTATAGCACGTTAACTGTAAAACCCCGTGCATTTTGATGAGTTATGGTAGTG
TCAACCAGCGCAGGAGTAGCGTCGAACGAGTCGGCGAGCAGCAGAGTCGAAGAACCTAATTTTCAGCTCATGAGTCGACCCATAAAT
CATCATGAGTCGACTCATCAGGTTGAGTCGACCCATGACTGTCATGAGTCGACTCATGATATCAACTCCTGTTGTCAAAAGTCTCTG
CTGAGTCGACTCATCACCTTATGAGTCGACCCATGAGTCATGAGTCGACTCACGACTGAACATGAGTCGACTCATCGAGGGTTTTCT
GGGTTTTTTCTGTGTCGGGGTTGTTTGGGTTTCGGGTTGGGTTTTAACTGTTCATATAAATTGTAAGTATAGCACGTTAAATTATAA
GTATAACACGTTATATCGTAAGTATAGCATGTTAACATGTAAGTATAGCACGTTAAATTGTAAGTATAGCACGTTAAATTATAAGTA
TAACACGTTATATCGTAAGTATAGCACGTTAAATTGTAAGTATAGCACGTTAAATTATAAGTATAACACGTTATATCGTAAGTATAG
CACGTTAAATTGTAAGTATAGCACGTTAAATTATAAGTATAACACGTTATATCATAAGTATAGCACGTTGACCTGTAAGTATAGCAT
GTTGACTTGTAAGTATAGCACGTTAAATTATAAGTATAGCATGTTAAATTGTAAGTATAACACGTTATATCGTAAGTATAACACGTT
ATATCGTAAGTATAGCACGTTGACCTGTAAGTATAGCACATTATCCTGTAAGTATAGCATGTTATCCTGTAAGTATAGCACGTTATC
CTGTAAGTATATCACGTTGTACTGTAAGTATAGCACGTTAAATTGTAAGTATAGCACGTTATCATGTAAGTATAGCACGTTATCATG
TAAGTATAGCACGTTACACTGTAAGTATAGCACGTTATACTGTAAGTATAGCACGTTATGCTGTAAGTATAGCACGTTATCGTGTAA
GTATAACATGTTATCATATAAGTATAGCACGTTATATCGTAAGTATAGCACGTTATCATGTAAGTATAGCATGTTACCATATAAGTA
TAGCATGTTATTATGTAAATATAGCACGTTATCATTGTAAGTATAACACATTATCCATGTAAGTATAGCATATTATTATGTAAGTAT
AGCACATAGATTGCAGTCCATCGATAACCTGTCGATCATCAATGGTTGACTTGTGACCATCGATGGTTAAAGGCTAAAATCTACAAC
TCATGTTGATGTTTGCATTATTTCGAGTCGTCACTTATTTGCACCCGTTTATTCCTAAAATATATCATCTCACAAACTCATTAGTAC
CAAATGAAAGTTTGTTGTTGATCAAACGGAGACATTGTCAAATTATCATTCAATAAGTACTCCAGCATTTATCAAAGCATAAACCAC
AGTGTGTGTAAAAATCAATAGCCTATTGGATTGCTCATATATCATCCGAACATTCATCATTCATTTTTTGTTAAACATTTCCTCCAA
ATTTCACAACTCTACCCTTAACCTTACATATTTTTTTCAACAACACTGATGAGAACCAACAAGATGAGGAAAGTTAAGTATGGCCCT
CGACCCTCACATCCAAAACATCGCCCGGTCGTACGCCATCGCGGCCTCTTCCGCCGTCTCGAACATCCCGAGCCAAACCCAAGCCCC
ATTCTTCCCGGGATCTCTCATCTCGGCAGCAAACTTCCCCCGTGGCCGCTATCTCACCCCTCTATAGCGCCTCTCCACCGCTGCGGG
AGCTGCCGCATCAGCCTACACTCAGGGCCGGTTCTGAGATTTTAGGGGCCCCGTGCAAAAATTAAACCAAATAAACTCTTCAGAAAT
TCAAAATGTATTAAAATTCAATGCTAAATAACTAAATTCCATTAAAATTTGAGAATTTACCAGTCATCTTATCATCAACCCCAGCAT
AATAGGAGTCATTAGAGGAGTAAGAGAACCCAACTCCTGCTGGTGTCTCCAAATACAACATATTAATGAAGGCTATAATGGGAATTT
AAGAGAAATATTTAAGGGGACCCACATATGAAAGTATACTTGGGTGTAAAGATAAATACAAAAAAAGAGTTGGGTTTAGATATACAA
GTAATAGTAGGTGGGTTTAAAAATAAAGTGGAGTAAACAATTGGGCCTAAAAACAAAAACCCCTATAAAAATATATCACTCCCCTGA
CAAAATATCAAAAACATACAAAAGGCACATCGCCAAAATACTAGTGGGTTCGGTGGAAAAGTGCATAAGCCAAATGAGGGACTCTTT
GCTAATTAGATCCTCCCTCATGATCGCCCGTTGATACATCATGCCATACAACTTATCAATCATTGTAGTAATCATGAACTTGATGCA

Fig. 13CM

CAATTCGGCATGAGCTAATCATGCAATAACTCCGTCCCTCACCTCTTCTAATAAGCAATACATGATCACTGTTGGATAGAGAATTCC
TAGTCTATTTTGGTAACATGAGGTTATTAGGATTCCTAATCTATTTTGGTAATAGGTTATTAGGATTCCTAATTTGATTTGCTTTTG
GTTTAGAATTCCTAGTATGTTTATGATTTTAGGATTTCTATATATATGGAACAATTAGAAGAGAGAATTGGTGGAGAAGAAAAAATTG
GGGATATTTGGAGCACAGAAAAGAGGTATTTTCTGAACTATTTGTTTAGGGTTTTGTTTGGAGAGATTAAGAGCTTGTTGGTGAGAT
TAGTTTGTTCCTTCGAGTGATTTGTAATCTCAGTTTGTACTCTTTCTCTATTAGTGAAAACCCCATCCCCTTCTAGCCCCGTGGACG
TAGGCAATTGCCGAACCACGTAAAACTATTATGTTTGGATTTGTGCCGTTGTTTTGATTTGTTTGGCCTTTATCTTGACGTTTGTTT
GATTTGGTTCTGGAAGCACGCCCGTTTGGTTGTCACGCTTCCGCGGCGCGCACAACAATCACAAACTCTAGCAATTGCATTAGCATC
GTTTGAGAAAACTTTCGACAATCGTTTCGTCACATCCAATCCTTCGATCATAGCTGAACAAACTCTTGAAGGTTGCAGAAAAATAAGA
ACCAGGAAATCAAGAAGTCACAAGGGAGGGACCCATGGACATCGCAGCTCAAGTGGCTGTATAGTTGTTTGGCCCCTTGTTCTTTCC
CAATTTTCACACATTGATTAATCCAACAATCAATTTTTAACTCTGCTTTTCCTGTAGACTTGGATGGCCTCTAATGACTTCAAGATT
CCCTTTTCCGATGCCACCTAATCCGTAGTGTAGCTTTAGAAGTTCATGAACAACAAGCTTGTCCCGCAAGAATAAAGAAATAGGTAA
GTAATTAGAATTCACTGCAATTCAATAAACAAACAACATAAAAGATTTAAAGAAGATTTCGTACTCTAGTTTGAAACCCAAAACACC
ATCCTCTTTCCTCACTTGGATCCGAAATTAACATTAAAATGAAATAAGAGATGAAAATTTTGGATGGAGAAGCGTGACCATTTATAG
CCTGATCTTGGCGTAGATAGCTAAATTGTGCGCGTGAGTCAAAGAGCCCGTGATCTCCAAAAACGATCATACCCTGCTGAGCTCTTT
CAGCTCACATTGTACTGTTCTCTGGCTTTTATAGCTTCTTACAAGCAAAGCACATGTGAACTGTAGTTACTGTACTATGTACTATTT
ACTTAAAAGCAAAAAAAAAAAAGATTCCCGCTATGAGGGTGAAAGAGCCAAAACGTTTCATTCAAGGGACCTATCTGCAACAACAGA
ACTACAGGGTTCACCCGCAATTCAGCGACAGTGCGGGGGTCTATCAGCAATTTACTCTAGTTCTAACTCCTGCAACAGAGCAGGACA
TCGAGCATCAAAACAAGCCACATGCCTTTGAGATCTGCTGTCTGTGGCCTTTTGACTTTACACGTGTTTTAGCTTGTTGATAAGTAT
GCTCACAAGAATACATGTTCATATAAATTCTTGAATATATAAAATATGTTTAGTTCAAACAAACCTGAGGCCACCCATTATGCAACC
TCGCATTTCTAACCACTGACAGAATAGTTTCAACTTTTTCAAATGCGTTAGAAAACGCAATGGTTTCCTTAAGTCCAAATTCTATGA
TCGAAACTTAGGGGAAAAAAATCTTAATAACGGTTTCTGAAAATATATAAGACCCAAAAAAGATCCTGCCATGCCGAGAACAAAGAT
ATCTACTTCTCTATATTTGTAGGAGGATCCTTGATGTGAGAAATTGTTCTATAGCATGTTCCTAATATGTTTTCTAATTTGTTTTGG
TAACATGTTATTAGCATTTCTAATCTGTTTTGGTAATAGGATTCTAAATCTATTTTGGTAATAGGTTATTAGGATTCCTAATCTGTT
TTGTTTTTTGGTTTTAGAATTCCTAGTATGTTTTTTGTTTTAGGATTTCTATATATATGGAACGATTGGAAGAGAGAATTGAGCAGC
GAAGGGGATATTTGGTGCATAGGGGATGTTTGGTTCGCTATTATAAGGGTGGAAAACTCAGAAAACCCCTCCACGTCAGATTTTTA
GCCATCCACGTCAGCTTTTTTTGTTTCCGTCCATTTCTTTGTGCCGCTTTGGTTCGCTCGAATGGAAGAGGGAAAACTCTGCTGAAA
TCGCCGCCAACTAAGATTTTTCTCTCTCTCCGATTTCCTTCCCCAACCAAGTGAAATTGATAAAAACTCTGTCACGTCAGATTTTTT
TCCTTCTCTGCTTTGTTTACAAAACTTTTCTTTTTTTTCCTATGCGAACCAAACACAAGAAAAGTAAATACATTGGTTTCCCACCAT
TTTTTATGTGCCAACCAAAGCAAAACAATCTATTTCTTGGAAAAATTTGAAAAACTCAAAACTTGTGTTTCTTTACATGGAATTGCA
TTTCTCTATATCAAAGAAACGAACCAAACAGCCCCATAGAAAAAAAAAGATTTTTTTTAGCTATTGGTTAGGGTTATTGTTTGAGAG
ATTGAGAGCTTTGTTAATGAGATAAGTTGATTGGTTTGAGTGATCTTGTAATCTCAGTTTGTACTCTCCTTCTCTATTAGTGAAAAT
CGCATCCCCTTTTGGCCCCGTGGACGTAGGCAACTTTCCGAACAACGTTAAAATTGGTTGTTTGTGTTCGTGCCGTTATTTTGAATT
GTTTGTGGCTTTCTCTCTCGGCGATTGGTTTGATTTCTCGAAGCACATCGGTTGATTGGCTTCCGCCGCACATAACAATGTAAAAGT
GTTCTATTATTTGCAGATTATTAAACAAACGACATGAATAAAAAATAATTGCATGCTACGACACATGTTCGTGTTATTAGGTACAAA
ATAAAATAAACATCTCACAAATACATGCCGCGGTTTCGAGATACATTTTCATGTATAGAAAGGCCTTCTCAATGCATGCTCTACCT
ATACTTAGGACTCATATCACGCTGCATTTATGAGACACGAAACATTGACGCAATCTGACAAAAAAAAGTTACAAATTTTGTTACAAT
GAGCTCTCCTTACTAACACGCAATTGCCGACAGATTGTAAATTTAGTTACATATCACACTTTCACACTGATAGCTTTTCTTCTATAC
TTCCAAAATACAGCCATCCTCCATCCATTGATGATGAATGTTTTCAACCTTTTTAGCTTTTGACAATAAGAAGTATATTTTCTTGTT
CTAGTATATTTTTATGGGTTTTTACATGAAGATAATCTTAACTTTTGTCTAAATTATACTTACCACTTTTAACCAAAATCACATACA
TGTGCTTATATATTTGCAATGTCACTTGTTTCACTATTCAGTTTAAAAAATTTCTATAATGCTTATTTAGGTGGAGGATATGGTGGA
GAAGATGGAGGAGGAGGGAGAGAGGGAGAGGAGAGGANNNNNNNNNNNNNNNNNNNNNNNNNNNNNNNNNNNNNNNNNNNNATACTAAAA
TAGGAAAAACACCTCATGGACCCAAAAATGGGACAGATAGAGGGAGACAGATGAGGTGTCCCCCCTCTGATTGCATAATGAGCTGGTA
ATGACCAGCTCATTATGCAATTAAGGGGGGACACCTCACCTGTCCCCCTATCTGTCTCATTTTTGGATACCTGTAGAAGCACCCCTA
AAATAGATATGCTCAAGACTTAAGTGTAATAAGTGCTCAAGTGTAACAAGTGCTAGCACTTGGCAGTGGATTCAAGTGTAACAAGTG
CTATCAGGTTTCCACCTGTATAATGTTAATGAGACTACTCTCTTCGAAATTATGCTCTCACGCTAAGAAATGAAATTTTTTATTAAC
TAAATAGAACTTTGATGCTTTATAATCACTCCTTTAGCATTTATATACTCTTAGTTGTATTTCATAGCATTTATATGCCCTGAGTTG
TTAGAAATTGGAAAATTAATACCCTTTGTTATGCAAACTTGAAATTTATCCTAATTATAGTTTTAAAATAGAGAATTTAGAAATACT
TGGTAATGAATTCAACAAAAAGTCATAAAATTAGCATATGAATGTTATATATGAATTATTGGATAAAAAAATCATATTTGTAAAACA
GAGGGTATTAATGTGCTAATTTTGAATTACTCAGGGTTTATAAATGCTAGGAAATACAACTAAACATATATAAGTGTTAAAAGAATG
AAACTATATAGTATTTAAGTGCTATTTAGCCTTTTTTTTATCTAACCCGTCGAAGTCAGGGTTGTGGATCTTCTATCTTTAGTTAGA
TTTTGCTGGGAAGGGAAAAGCTAGAAGACAAATTCTATGAGCTCTATTTATATTTATCTATGCTACTATACAAAAATCAAGTGAGAC
AATCAAAAAATTATGGGAAAAATGTTTCAAGGCCCCAAAACCAAAAATCGGATGTGGCCCAGCCCCCCCAATTATCTGCCTTAGCCT
TCAGCCCCAAAAAATTGCGAAAATTAATTCTAGCTTTTTTCTAATAAAAGGACATTTCACATTCAAGCAATTTGTTGTGTACAGCTA
AGCATTCCTTTTCCTTGAGGATGAAAGAATGACTTAGTGGATTGATCTGAAGGTTCCTTGTTGTGTACAGCAATTTGGTTTTTCTCT
CGAGAGTAACTCTCGCAAATCAGAGACCCGAGGACAATTCTTCATCGGGGATGAAACCCCCTGTCCTTGGATGGGCGAAATTGGTTC
TTGTTGACATTAATGAAATTAGGGTTTTTTTCAACTGTCTACAGCCCTTTTGCACCTGAAATCCCCTCAATTACTCATCAACTCCTC
ATAATTGCCTTCATTACTGTCCTCATAACTTTCAACCACCCCTAATAGCCGCCAATGACTTGATTTGCATGGTGTCTTTAGGCGAGA
ATGCCATATTCGTGAAGCTAAGTTCGACAACAAGCTTTGATGAACTCCAATTTGATGTGTCTGAAAGATTGAAAGTACCTAAAGAAG
CTTTATCCTTTATATTTAAATCTGAGAGGCACCCCAACCTCAGTTTTTCAGTTGACAACGATGATGATTTGAAGTGCATGTTGGAGC
ACAATCGAAATATTGGTTGTACGGAGATTCACATGCAAGCTGCTGTTAATGTAGAGTGTTCCACTTCAAGGAAAAATCAGATTAGGG

Fig. 13CN

AAATGTAAGTAATTAATGAACTCTTTATAACATTGGGTTTTGTGTGATGTAAACATTGTTATTTTTTTCTTCAACTTTCAACCATCC
CTTATGGGCATCAAATCCCTCAATGTAAGTTATTAATGATTTGTAAGTAAACAATGAACTCTGTCAGGAACAGGTCTATGTGTGATG
ATAAGCCAATTGTGATTTCAGGTTTCGATGCTAACTTGGGAAAAAATAGTTGTCATCTCTGATGGTTAGATGTTAACTCTTCATCTT
ACAGGTTAATTTTCCAAGAGATATGTTAACCTTTACATGAACATGTTAATTGTCGTGGGAACATGGTTAATTTTACACCCAGTTAGT
TAACTTTTGTTGTACTATGTTACCTTTGGTCCTACTGCTGTTAACTTAAATTATCAGAAGATAATATAACATATTGTGCATGATATC
TCACTGGTTGATTAATTTGTGCAGTAGTGATGCCTCTTTGAATGCAGAATATAGTCGTCCTCCTCCAGGAAATGCATCCAATTCAGA
GAGAATCCAAAATGATTTCCCGTCTGGTGAGGTTGTAATGAGAGCTGATGATATTCTCAACAACACTTCCAGCATTCCTCAATAATG
GGGGTTTAGTTACCCCATTAGTCGGCTGTAACAACCCACTAAAGCCACTCCTTAAATCGTGGGTGAAGAACAGCTTCGAAGTTGTTA
TGATCACGTTTGAATGAGTCAGAACCTTGACCTGCGTTCTGGCGGTGATTGAGCTGTGTTGGGCAGCGACTGACGGGCTGCGTTGGG
CAGTGATGGATGAGCTGCGTTGGCAGCGGTTGATAAGCTGCGTTGGCCAGTGATGGAGCTGCGTTCGAGCTGTGCTTGGCAGCGATT
GGAGCTGCGTTGGAGCTGTGCTTGGCAGCGATTGGAGCTGCGTTCGAGCTGTGCTTGGCAGCGATTGGAGCTGCGTTCGAGCTGTAC
TTGGCAGCGATTGGAGCTGCGTTCGAGCAGCGATTGGAGCTGCGTTCGAGCTGTGCTTGGCAGCGATTGGAGCTGCGTTCGAGCTGT
TGATTGTTGTAGTATTTAGATTTCTCTGTCTTTATATATGGATGACACCAAAGACCAGTAAAGAAGGTCTTATTCAGCCATTTGTG
ACAATTGAAGCATCTCAATAACGCTCTATCAACTGCAGGTCATGATCTCCACTGAGTGTGTCGAATATCATTACACTGCTCATCAGC
ACCTCTAATGGTTGCTAATATAATATTAGTCATGTTGTTGTCGCAGCCATCAAGATCAATCATCTCACATATGAAGCTGCATTCGTG
TTTGTAGCTGTTGAAGCGGCATAGGTGATTGAATCGGTGTAGTGTCTTGATGATGGTACGCCGGGAGGACTTTCACGTCTTGGTTTG
AAGAGATCGTTGATTTATAATCCCTTTCTGTCAGAGTATTGCTAAAGACTGTCGTTTTGTAACCTTTGCTTTAACTCTTTGACATGT
AATCCCTTTCTGTCAGAGTATTGCTAAAGACTGTCGTTTTGTAACCTTTGCTTTAACTCTTTGACATGTGAAAATCTTCGAATTGTA
GCCTTCTGGAAGTCGTCAGATTGTAACTTCCATCATCAGTGTTCGATGGAGACTCAGCTATCTATTGTGCTTTTTAGACAGCCTACA
GCTCCCAAGCTCTGTGCCACGCCAGCCCAAAGCAGCTCCTTCTGAGCTTGCTAGAGAGAGTTCACGAGCTCCCACCGCCACGTAGGA
CTTGAGAGTGGCCGGTGGAGCTTGATGGACTTGCTCTTAGCATATTCTTGTGAGATACCCATGTGAGCTGTCACATGGTATTTACT
ATAGCTTTATATACCTAAAGTTCATCCAAATTACAATACAACGACCCCTCTCCTATATTACTTAGTTTCTAAATGGGGAAGGAGCAT
TTTAGTGTTTATGAAAATTTTAGGGAAAAATGTGTCCAGGCCCCAAAAACATAAACTTCATGTGCTGCAGCCCCTTCTAGTTTCCC
CCATGTGGTTCAGCCCCTTGAAGTGTGACGTTTTGTGCTGCAGCCCCTTTTTAACAATTATTACATGCCAACTAAGCTAAAATCCCC
AAAATAACCTTACCCCCTCTCCTCAATCCTTCAAACCCAGTTCTCTCTCTCTCTCTCCCCCCTCTCTCTCCCCCTCTCTCTCTTTAAA
AACAAGGGTTTTATCAAGCTCGTCGCTCTGGCCCTCGCCCTCCTCGCCGTCGCCACCTCCGCCCAGGCTCCCAAGCCTCCCCCGAGT
TCGTCGCCGCCTCCCCTCCTCTCCTCCGCCCGACCTCGTCGCGGTAGCTCGCCGTCGCTCCCCATCTCGCCCTCGACTACGCCGGAG
TTCGTCGCTGTGCCTGCCACTTTTGAACCCATAGTATGGTAGGCCGGAGGAGGATGACCAAGAGAAAAGAGTGCATGATGCTCAAGA
AAAGTAAAAATGAAGGGGACAGAATAGAACTAACATTGTGCAGATTAGAACTAACACTGTAGACAGAATAGAACTAACATTGTAGAC
AGAATAGAACTAACATTGTAGACAGAATAGAACTAACATTGTAGACAGAATAGAACTAACATTGTAGACAGAATAGAACTAACATTG
TAGACAGAATAGAACTAACATTGTAGACAGAATAGAACTGTAGACAGAATAGAACTAACATTGTAGACAGAATAGAACTAACATTGT
AGACAGAATAGAACTAACATTGTAGACAGAATAGAACTAACATTGTAGACAGAATAGAACTAACATTGTAGATAGAATAGAACTGTA
GACAGAATAGAACTAACATTATAGACAGAATAGAACTAACATTGTAGACAGAATAGAACTGTAGACAGAACAGAACTAACATTATAG
ACAGAATAGCATATTCTTGTACTTTAACTTGGAACTAGATGCAACTTATGACTCTGTCTAGTTTCTGGTATTGGTTTATGATTCAAC
AAATGAGCATGCTCATATTCTTTACAGAAATTTACACCCTGTCATTAGATTGAAATAGAGCATTCTGGCTGTTTCGTCATTGGTTGA
CAATAACAGTATCAGTTTCTTAATGTGTTCCTCTGCCTGTTTAAGCTCTCGAGCTGGACTTCTGGATTACTATAGACATGTAGTTCG
TTTGCATACAACTTTTAGTGGTTTGAAATTGACTACGTGGTTACAGTTTTCTATTTTGGAAATGGGAACGTATCGTAAATCATGCAG
CATTTTGCTCCTTGGCAACATTTTGGCTGACTACTATTCTCAATTCTGTAAACAGGAACCATGCTTTGAAAATGGGCAAAAGCAGCA
GGAAGACTCTACACAATTGTCACGAGTGTGAAGAATCTGCGAGACATGCTGGAATGCCTCAATCTTTACTTCGAATCCCTTCAACCA
AGTTTGTAATTGACCCAACAACTTTCTTATAGGGTGATTGTATTTTGGACAATTCTGGACAGAAATAATTTGGGTTGGTAACAACAG
AAATTACAAACTCAATAAGCGGCACGAACTTGGTTGAAGGGATTCAAAGTAAAGATTGAGGCATTCCAGCATGTCTCGCAGATTCTT
CACACTCGTGACAATTGTGTAGAGTCTTCCTGCTGCTTTGCCCATTTTCAAAGCATGGTTCCTGTTTACAGAATTGACAATAGTAG
TCAGCCAAAATGTTTCCAAGGAGCAAAATGTTGCATGATTTACGATACGTTCCCATTTCCAAAATAGAAAACTGTAACTACGTAGTT
AATTTCAAACCACTAAAACTTGTATGCAAACGAACTACATGTCTATAGTAATCCAGAAGTCCAGCTCGACAGCTTAAACAGGCAGAG
GAACACATTAAGAAACTGATACTGTTATTGTCAACCAATGACGAAACAGCCAGAATGCTCTATTTCAATCTAATGACAGGGTGTAAA
TTTCTGTAAAGAATATGAGCATGCTCATTTGTTGAATCATAAACCAATACCAGAAACTAGACAGAGTCATAAGTTGCATCTAGTTCC
AAGTTAAAGTACAAGAATATGCTATTCTGTCTATAATGTTAGTTCTGTTCTGTCTACAGTTCTATTCTGTCTACAATGTTAGTTCTA
TTCTGTCTATAATGTTAGTTCTATTCTGTCTACAGTTCTATTCTATCTACAATGTTAGTTCTATTCTGTCTACAATGTTAGTTCTAT
TCTGTCTACAATGTTAGTTCTATTCTGTCTACAATGTTAGTTCTATTCTGTCTACAATGTTAGTTCTATTCTGTCTACAATGTTAGT
TCTATTCTGTCTACAATGTTAGTTCTATTCTGTCTACAATGTTAGTTCTATTCTGTCTACAATGTTAGTTCTATTCTGTCTACAATG
TTAGTTCTATTCTGTCTACAATGTTAGTTCTATTCTGTCTACAATGTTAGTTCTATTCTGTCTACAATGTTAGTTCTATTCTGTCTA
CAATGTTAGTTCTATTCTGTCTACAATGTTAGTTCTATTCTGTCTACAATGTTAGTTCTATTCTGTCTACAATGTTAGTTCTAGTAA
TAATTGTTAAAAAGGAGCTGCAGCACAAAACGTCACACTTCAAGGGGCTGAACCACATGGGGGAAACTAGAAGGGGCTGCAGCACAT
GAAGTTTATGTTTTTGGGGCCTGGACACATTTTTCCCAAAATTTTAATGGTAGCAATGTTTATTAATGGGGGGTTATTAGGGCAAAT
AATAGTCACTTATTTTCAAGGTTGGTAAAATTATATGGCATTTTTCTGCAATTTAGCCTAAAAGCTATCCACATTGTTAATTGGCGG
CAATGAAAGTGCTACTGGCGGCAATGAACAAGTAGTTCAAAGAGATGTCAGTGGTGCTGATGGTAACGATATAGAGTTGGAAGTGTT
TATGGGCTTCGATCGTCATACCAACAATATCTGAGGAGTGTGTGACCCAGCTATGAGCCAAGGAAAAGCAGTTGAGATCGTAAGGAG
TACGTCGGGAAGACGATAAGTGATTGGCAATTGACAAGTTTAAAGTATTTTGCAAGCATTTTATTTTGGGAGACTGATTTGTGTGAA
ATGTGCTTGATGAACAACTTATTGTGTCTACGTGCTGCTGACGTGTGTGCTCGCGCTTTTTTTCTTTTTTCTTTTTTTTTTCTTTTT
TGACACACAGCTCATTGCATCAATGTGCTTATTGTGTTGTTTTTGTAACTCACAGTTAACACACAGATTGTGTGTGTAAACTTAACC

Fig. 13CO

AACTAGCTCTTGATATTGGATGCTCTAATTGTTATATTTTGATAGACATTGTAGACGGTTAACAGTATTTTCAACCAGGCCAATGAT
CGGTGTAGATCTAAGAAGTGAACGCCCATGGGCAAAACACTTTAAATAAGCATACAACTGAGCCCACAATAAACTGTACCGAAGATT
GCCTAACCAATCAAGCCAACGTCGCTGAACAACCCATTTCAACTCGAGTCGACCAAATCAAGAGCGAGTCGACTCCCGAACTGCGCC
CCAGGCCAAGTCAAAAGGCATCATCCGTAGGCCAAATCATGAGTGAAATTATGTGTCAACTTCGAACTTATAGACGAAGTCCGCCAA
TCGATGAACTTCGCTCATAACAACCCAAGTGGACCAAGTCATCCACACTTTCGGCGAACCTCGCCCAAAAGTCTTCAGTAGCGAACT
TCACCCAAAAGTCTTCGGTAGCGAACTTCGCCCAAATGTCTTCAGCAACGAACTTCGTCAAAACATCTTCAGCAAGTTTCGCCAAAA
TGTCCTCAACGAGCTTCGCCAAGTCAGCGAACCTCGTTTAATAGCCGTTTGAGGGCTATTTTTAAAGGATAAATCCCACTATTTTCT
ATTTTAATGGCCACTTAATCCATAATTAAAGGTCATTAGCTCTCTCTTTTACCCTATAAAAGTAGGGAAGATCATTCATTTTTGGGC
ATCATCGAAGGAGATCTATAGATCTAGCCACATGCATAGAGAGATCTACTATTGCACTTACAATTCTATTGAGAAGATCTGCTAAGA
GAAGACTGAGTCGTTTTCTAAGCAACCAAACTCTTATCAATAGCAAAAGACTTGTTGTCTCGACCTGTGCATTAACGGAGTACAAGA
TCGACACTTCAACGGTACACGAAAAAGAATCCCAGAAAAATTCAAAATTTTTCTTAATTTCATTATAATTCTTTATATTGTAATCTG
AGTTAATTGCAATTTAAAAAGCCCCGAAATAGACATGATGATGATGATGATTTTTAAGCTTCAGGGTTAATTGTACATACAGGTGCC
TAGTTTGTCATTTGAGTTTATGAATTTAGCGTATTATATATGCTCAAGTGCTTTAAGAAGAAAGTGAAGAGTACTAGATTATTTGCT
ATGTAATTTATACCTTGAGACAAAGATACATGGTGTATATAGTATAAAAATAAAAGTGAAGAGCACTGGATTATTTGCTATGTAATT
TATACCTTGAGGCAGAGATACATGGTACATACAAGTATAAAAATAAAATTCATAGAAAATGTAAACCATTGGAGGAGCATAAAAATT
TTGAAAGGTCTGTGATTATACATTTTTTTGGTCATTTCCTATTCATATCTAAGTCATGTCTGTTTCGTAAATATCTGATTTGTATTT
GTAATTGTATCTATATCCATTTCTATAATATCCAAATCATATTCGTTTCTGATTTAATGCAAATTTACTCACAAAAGAACATCCTTA
TCTTTTTTTAGAAGGTGAATATGAAGATATGATACATGTCATATCTGAACCGAATGCACATTGAGTATTGGAGGAGGGGGAGGCAA
ACAAAATTATGGTGGAATTTTGTGATTATTAATGAGTAAATTCCTATTTAGCGTGTTTAGTAAACTGGGACCCATGAAAGCTGGGCC
GTTAGATTCATTCAAGACCAGCTGAAGATCGCTACAAGAAGGGGCCGAGACAGCCTAGTGGGGTCTGTGTTAGAATTAAAAAAATTA
ATGACTTGTTTAGATGATAATTTTGGTATTTTGACAAAATAAAATTCTTCCATGTCCCCGAGTTCGTAGCATTTTGAAACAATTCCC
TATAAAATTATTTACATTTTCATTGTTTTTTATTTTTATTTTTTTTGGTAAATGAAAAATTTTATTCATCCACCAATATGAAATTTT
TGTATGTACATCAAGAATCTCATCACATTTTGAGATATCCAAAACCTGTAACTAAAGCTCAAAAGAAAAAACTCATATATACAGAGC
TTTACAAGGAGAGTAACCAATCTCTCTTCTCAACTGGAATTTGAGTGTTTAGATTTGTAATCAAAATATTCATCTTTATATCTTTAA
CCAAACACTCCATGCTTCTATTTTTGTTTTGAAAAATCCTGGCGTTCCTTTCACTCCATATCCTGTAAATTGTAGCAGATAAAGTCA
TGCGCTTGATCCCTTGCTTATATCATCTGCCCCTCAGCTTTGTGCAAAACTAATCCAATAGAAGTCCCCACTCACATGACTTCCAAG
TGAATTAAAGCCAATTCATAATGCAATTCCACACCTCATTTGAAAATCTGCATTCAAAAAATAGATGGTTTCGACTTTCTAAACCTC
CACCAGCACATAAACTGTAAACATTTGTATTAATGACTCCCCTCTTCATCAATCTATCCTGTGTGAGCAGTCGATTTGCACAGCAA
GCAAGCAAATGAATGAGTGTTTGGATAACTCATCCTTTCCCAAACGGTGTCATGCTAAGGCACTCTTTGAGAACAGGGCAGAGAGA
ATTGTATAAGAATGATATCTGAGATTTTGATTTATTGAAACAGGAGCTCAAAAGCTGCAACAGAATTTTAACCCCGCCATAGGAAAT
CACAGCTTTATCTCTTTTTTCAACATTTGCTTCCACATCCAAGAATCACCATTTTTAGAAGTAACATGTCAGATATCATTTTGCCTC
AAGTTAGTCCCATGAACCCATTTGATCCAAAGGGTTTCCTTATTTGTATGAATGAACCATAAGTTCTTCAAAGCTGCTGCCATATTT
CAAATTGAAGCAGAAAAAATTCCTAGACCATCCTGTTTTCTATCCAGACAAACAGTGTCCCAAGCAACTAGAGGATTTTTTGAAGGT
TGATATGTTTTACCCCATAGGAAATTCCTACACAATTCATCAACCTTTTGTGTTACTTTGACAGGTAGTATATAATTTGAGGTCCAA
AAAACCTGCACACCCAGAATTACACTCTTTATAACTTGTAGTCTTCCTGCATATGTTAGCTTTTTGTGTTTTGACCATGTGAGAAGC
TGGCTTGATACTTTGTTGATAAGTGCATTGCAATCCACATAAGATAGATTCTTGCATATGAGTGGAACCCCCAAGTATCTGATTGGG
AGACTACCTTCTTTGAAGCCCAGAAGATTTATAATAGCAGATTTGAAAGTGTCATCAACTCCACCAAAGAAAACTGAACATTTATCT
TGATTAACTTCAAGCCTAGAAATTTCACCAAATTTTTTTAACACACTGATACAAATTCTGCACTGAGTATGAGTCAGCCTTCCCAAA
TAACAGCAGGTCATCGGCAAAGATAATATGTGTGAGCTTTAAGTTAGCACGGTTGGGATGAAATTTGACTTTCTTGTCAAGCTTTAA
TACATCCAAACTTCTTGATAGGTATTCCATACCCAATATAAAAATATATAGAGAAAGAGGATCACATTGTCTCAAACCTTTCTCACC
CTTAAAAACCCTATGGAGAGAACCATTTAGAGAAATGGAGAATTTTGGGTTAGAAACACATATCATGATCATGTCAATCATAAAATC
TAGAAACCCCAGCCCCTTGAGCATAGTATTAAGAAAATTTCAGCTAATTGTGTCAAAGGCTTTTTTGATATTAATGTTTAACATGAT
TCTAGGAGATATATGTTTCCTACTATATCCCTTGATTAATTCATGTGCTAACAAGATATTTCTTGTTATTTGTCTGCCCTTAATAAA
AGCATTCTGTCCTTCATTCACCAAATAACCCAAAACAAATTTTATTCTATTTGCCAAGACTTTTAAGATAAACTTGTATACGCTATT
GCAGCAAGAAATAGGCAAAAACTTTGCTGGAGTTTTTGGGCATTTTACCTTAGGGATAAGTGTAATTGATGTAGCATTTACCACACC
CAAAAGTTTACCAGAATTAAAGAATTCCTCAATGGCTAAAGTTACTTCTTCTCGCTCAATCAGCCATGCCCATTTGAAGAAAGAAAT
ACCATATCCATTAGGACCAGGAGAATTGTTATCAGACATGGAAAAGATGGCTTATTTTATTTCTTCTTTTGTTACAGGTTTTGAGAG
CAGTCTGGCTTGTGAACTAGACAAACATGGACCAGATTTAATAATCTCTATATCAGGATTTGTAGTGTCTGATGCTTTCCCCATGAG
GTTTTGGTAATATGAAACAAATTCATTAACAGTCTCATCATAATATGTAATTCTTTGCCCAGCACTATTATAGAGGACCATCACTTT
GTTGTGATGTCTATTTATATTAATGATAGAGTGGAAAAAATTTGTGCATCTGTCTCCTTTGATCCCCCAGGCAATTCTAGCTTTTTT
CTAATAAAAGGACATTTCACATTCAAGCAATTTGTTGTGTACAGCTAAGCATTCATTTTCCTTGATGATGAAAGAATGACTTAGTGG
ATTGATCTGAAGGTTCCTTTAAACTTATTCCAAAGCTTGCCTAGCCCTCAGGACTTGTTCACTGATGTTGGGAAATACCTCTTGTT
AATATCCTTGAGAACTCCTTTCAGGTTTTTTAACTTTGTACAAACTGAATACATTTTGTAACCTGCAATATCAGTTCCCCAAGTGCT
AGCTACTGCAGGTAGGAATCTATCATGCTTTGCCCACTATTAAAGAATTTAAAAGGTTTTTGACCTTGCACTCTGTCCTCAAATATA
GAAACCAAAGCAGGAGAATGGTCTGAAAAATTAGAGACATGGAACTCAGCCTGACTAGATTGGAACACATGCATCCAAGAATCATTT
ACCAGAGCTCTGTCTAGCCTACACCAAATCCTTGAATTAGTGTCTTATTTATTATTTCATGTGTAGAAACACCTAATTGATTTTAGG
TGGTTTAAAAGGCAATCATGAATGAAATCCCTGAAATCCCTGAAATCAACCTCAGTGAGCAAAGAGCCTCTCAGTTTCTCATCATTG
CTAATAACAGAGTTAAAATCCCCACACAAGAGCCAAGGTGTAGTTCCAATTGAATTATGAATAAGCTTTAAACCAGTCCATAACTCC
CTCCTGGCTTCTATATGATTTAAAACATAAACTGTTGAGATAATACTATCAAATCTCCCATCCAAAGATTTAACAGAGCATGTTATT
TGTTGAGGTGAGAGACTTACAATGTTAATGTCTAGAATATTTGGATCCCACAAGATCATAATTCTGGTTTTACTAGCATAACCAGAG

Fig. 13CP

TTTGAAAGATAACTCCAATTGCTAGCAATTTTCTTGGCTATAAAAGGCAACATTCTGTCTTTTATTTTTGTTTCTAATAAATCTAGG
AAAGATGGGTGATACTGAGCTATGAAATGTTTCACCAAATGCTGTTTAGAGGACTTATTCAGTCCCCTAACATTCTAAAATGTAAGG
TTAATTTTTTTAAAACCAGCCCTCCTCTATCAATTGTAGAGGGATCAAGTATCAAAGAGTCCAGATGAGAAAATGTATTGACAGGAG
CAACAGGTTGCTTTTGATTTCTTCTTTGGATTTGAACCCAAAAGCTTTCAGCTTGAGAAGATCCTTTCCCTGAATTCAGAACATGCA
CAGCATGCGCAGGCTCTATGTTCTTTAATCCTCCAGCAACATGTGTTGGTTCTCCCTTAGCTAATATAGACTTGAAACATTTTGTTG
ACCATTTGTTTGTGAATTCACTTGCATATGTTGCTGCCCATATTTAGAATATGTTGGTTCTCCCTTAGCTAATATAGACTTGAAACA
TTTTGTTGACCATTTGTTTGTGAATTCCCTTGTTGCTCCCTCCAGCTAGATTTTGATCAAAAATTTCCACTTCATTGATAACTGGAT
TTGGTGCATCATGGATAGTAGTATTTCCAGGTACTGTTTTTTGTTTGGGGATCCATTTTTGGACTCTATGCATCTTCCTGCAAAAAT
TTATGTCATGTCCTACAACTTTGCACAAATCACACCATCTTGGCTTAAATTCATAATGAGCCATTTGATCATAACTTTTCCCATCAG
GCCCTTGTAATATGATATGATCAGATAGAGGAGAAGGCATTTTAACATCCACCAAGACTCTAGCATATGCCGACCTTTGTTTATTAG
CAGTCAACTTATCAGTTGCAATAGACCTACTGTAGGCATTAAAAAATGTTGAAAGATATTCAAACGCAGCTCAAAAGGAAGTCATCC
AAAAATCAAAAAAGGACACAAGTATAGACTGTCTCGCACGCGAGACAGTGTTCACTGTCTCGCACGCGAGACAGCTTTCAAGCACGC
GAGACAGTGTTCACTGTCTCGCACGCGAGACAGCTTTCAAAGGTTCAGAACTGTTTTATAACCACTGACACGTGGCCACCAACTGTT
CAAGAACGTGGGAAACGTCGTGGCGAGAATCACATTGATAACTGCTAAGATAACGGAGTTTTAAAACGTGGGAAGACAGTTACAAG
AAAACTGTCGGGCAGTTGAAGATTTCTGAGACAGTATTTACTGTCTCGAAACCCGAGACAGTGTTTACTGTCTCGGAACCCGAGACA
GTCTTTGCTGTCTCGACCGCCGAGCGCCGAGACAGCAAATACTGTCTCAGAAATGGTTATTTGTTCAGGGACTATAAATACCCCCCT
GAGATCGATAAACAGGGGGCTGAGCATTTTTAGAGCAGATAGAGCAGAGTACTTGAGCTTCTGGCAATTCCTTGAGATTCGAGCTT
TGACTTGATCTTAAGAAGAACGATCGTCTTACTTTGATATGATCTTCGTTTCAAATTCTCACTTTGATAAATGAAGGAAGAATCACT
AAACCCCTCACGATCTGTGATTTGGTGGTCCACGGGCTAACGCACCCCCGGCACAGGCAAAGATCTCACACAAGCAGCGATCCAAAC
AACGATCCTGCGTTTGTTTCTAAAAAGTTATAATTTTCCTTTTGTTGTGTAAAAGAAGTCTTATAAAAAGGCTATTTTTTTTTAATT
TGTTGTAATCGAGCGAAGATATAATGAATTCCACAACGAGACCAACTTTTGACCGAAAACAAACTGGCGACCACAGTGGGAGCCAACG
GTCTCGCTGCCGAGACCGTCGTGTCGCAGCCGATCAAGATACTGGTTGAGTCCATGGTTGAATATGAATTCGACCAAGTAAAGTTTG
AGGAATATCTGTCATCCTCATCCTCAAAGTCTTCCTCGCCTCACAAATGCAGGAAGATTCCATCTTCTAAGAAGGTTTTTAAGTTTT
CGACTCCGTCGAACACTACAGATGAAGACTCTCGCTTGATTGTTGCTGAGGATTCTACTCGCAACCTCTCTGCTCACAATGACTCTT
ATCTAGTTAAAGAGTCATCGAATCAAAGCCCACCGGCACTGACGAAGAGGGCTCGTCAGAGACAACGTCAGCGCCGCGCTCGCCAAA
TAGCTAAGGCCTTGGAACAAACCGACGGGATTCGTTATCACGCGGACCTAGAGTCGAGGAGGTATCAAGTGGTTCAGTTGTCTCAAC
AACCAATCACTCATATCTCTGCTAAACTAATGACGGATGAATGGACTTTTGTCAAGAGGACTCGCTTAACCCTCAAAGAATGTATAC
AGAAGCGTCGTGCAAACGCTGCTCATGCCCGTGCTCTCTTACAACAAAGACGAGAAAGGAACAAGAAAACGGTGGCCAAAGAACCAC
TAAAACTCTACAAAGTTTGGATTCCAAAGTCTGGAGTTGTACAAAATCAGCATTCGGAGCCCGTTAAGACTCCGCACCCGTAAGGGG
GTGGTTCTAAACGTGTGACTCCTGACATAACCTTGGATCGCTCAAATGCGACAACAAGTTGTCCTGAGAATGCCAATAAGGCTTTAC
ACCCACAGAAAAAGATGTGTTCGTTAAAAGACATCGTTATACCTGGGAGGTCATACCAACAGACGATCGGATTTTCCGGCAATCATA
CCGATGAGTCGTACTATCAAGCTGTAGGTGTGAATAAATTTCGAAAGAGAATTATTCGAGAAATAAGCTCTCATTGTTCCTATGCGC
GACTCATTAGAGGAGCATTTTTGGAATATGACTACTCCAAACGAGAAGCCATCCCGCAAAAAATCTCAGTGTTCCAGAGGCTTTTTA
CCAAAATATCAAAGCCCAAGCCGAGATATTTCCGCAAGAAGCTTGCTGTTCAGGAGGATGAACTCTCTAAAGTCATCATCAACATGG
TTGATAAGAAAGTCTAAGCGGCATTCAATGGACTCAAATCCCGACTTTTCCCCGAGAGGAAAAGTCAATCCAAGAATGGCTCAACGG
ATGTCTCGACTCCAGTTAGAAGCCATCAGACGTAGGGATTACAAGAGAATGCATGAAGGAATATCCTCGGAGGATGAACTTTCAGAC
ACTTGTTCAGCCATTGCTTCTGATGATACAATGTCTAGCACGGGACAAACCAAAGAAGTGTTCACAATCACTTCTGATCAATTTGCT
CAAATGCTTCAAGAAGCTCTAGCCAAGCAACGTGAAGAAATTAGAGCTGAGATGAAGACAGAGATGGAGTTGGCTATCCAACAAATG
AGAGAATTGCTCGCTCAACGGCCTCAATCTCCTGAGTCTAGTCAGCGAGTTAAATCCAGCCGCCACACTCAGAATATTGTAGATAAC
AGTGATCCAAAAGTGGATGAAGTTATTATGGCTGATACACCTCCCAATGACAATAACACTGGGGGTGGTTCAACAGATCCTCCCAAC
AACAATATTGGGGGTGGTTCAATTTCACCTCTTAATAACACTGGGGGTGGCTCAATTATTTCTGCTCAACATCACTCAAAGAGAGAT
GAAGATGAGGACAAGAAAATGCAAGACCTTGAAAACAAAGTCAATGCTTTGATGTCCGCTCAGGAAGTAAAGAAGACGGGTATTCCG
TATCCCTATCCAAGAGAATGGGATTCAATACCGTACCCGACAAAGTTCAATCTGATTAACTTCACACCATTTGATGGGAAGAGCTCG
CCTACTTAGCACTTGATTTATTTCAAGTCTCATTTGGGCATGATCTCTGGAAATGAGGCTTTAATGGTCCGGTCATTCGTTGGCACC
CTTCGTGGGCCCGCCTTCGATTGGTACCGACGTCTCAAGCCAGGGAGCATCAATTGCTAGAATGACATAGAAAGTTTGTTCCTCAGC
AATTTCTTCGATGATGACATCGAAGTGTCAATCGGAACCCTTTTAGATGAGAAGCAAAAAGACGGAGAGTCAGTCGATAATTTTGTC
AAACGCTTCCCTAACAAAGCAATTAATTGCAGAGATCCTATTACAGAGGAGTTTATCCTACAAACATGCCACAATAATCTCTCCATC
GATGTCCTGGAAGCCCTGGGGTCATACCATCCAAAACTTAGAAAGATTTGAAAATGCGCGGCGAACAAGCTGAACACTTTCTTAAA
AGAAAGAAAGCTGAGAGAAGCCGACCGACGACATCTACAATCACTGAGAACGCGACTCTCGATCCGAAGTTTCAAAAGGAGTATTCT
TTCGAAAATGATGAAGCTCCAGCCATATTGAAATACCTCCTCGCCAATAATAAAATCGAGCTACCACCTATTAAAGATCAAGAGAGA
GCTAAGAGAATTACGGATCTAAACTACTGTGCGTACCACAGAAGGGTTCTTCATCCTACCGAGATCTGCTTCGGACTCAAAAACAAA
ATCCAAGCCTTAATTGACTCCGGCGTCATAACGGCGAAACAAGCCAAGTAAAGACGACTCTAACTCCATTGGATACACGAGTATAAA
TTGTTTCCCCTAACTCCGAAGAGTATGCGAGTATAAACTGCTTCTCAAGCCTCCAACCGGTATACGAGGATAAACTGCTCCCTGAAA
CTCCAATAGGTATATTAGTCTAAACTGTTTCCCACTCTTGACGGGAAGTTCCTGGAGAATTTTTACATGTAATATTCTTAAGGATAT
CCTGGAGAATTTTTACATGTAATATTCTTAAGGATAACCTGGTCATGTAACTCAGTATGATATAAACCTAGTTTCGTAGAGAAAGCT
GGGGGTGGATGGTTCATGTAACGGGAAGTTCTCGGAAGAATGCTATATGTAATTTTCTTAGGGATAACCTGATCATTACAAACAAAG
TGATAAACACTACATCCCCACGGTGATTTCCGAATACTCTTTTGCTGAGATGAGATTCGATCACTTCGTTGGATCAATCTTCCGTCT
CAAATTCTCATTTGGTCAAACATTTAAACAGTTAGGACCAAAGCCAAAATCCCCTCTCGATTCCTTCAATGAACGAGAGGTCCACAA
ATCGAACGATCAAACCTTCCTACAGTTAGGATCGTCTCAAGTTCTCATTTGGTCAAACCTTTAAACAGTTAATACCAAAGCCAAAAT
CCCCTCTCGATTCCTTCCATGAACGAGAGGTCCACAAATTAAACGATCAAACCTTTAAACAGTTAGGATCGTCTCAAATTCTCATTT

Fig. 13CQ

GGTCAAACCTTTAAACAGTTAGGACCAAAGCCAAACTCCCCTCTCGATTCCTTCCATGAACGAGAGGTCCACAAATTGAACGATCAA
ACCTTTAAACAGTTAGGATCGTCTCAAATTCCCATTTGGTCAAACCTTTAAACAGTTAGGACCAGAGCCAAAATCCCCTCTCGATTC
CTTTCATGAACGAGAGGTCTACAAATTGAACGATTAAACCTTTAAACAGTTAGGATCATCTCAAAACTCCGACTTGGTCAAACCTTA
CTACAGTTAGGACCACAATCAAGATTCCCTTTCAATTCATTTCACGAACCGAGAGGTCTACTTTTGAATTGAATAATCAAACCTTATG
ACATTCAGGATTATTCAAACCAGTCCAGATTCTCTAAGTGGAGATCCCACTTTGAGTTTCTTTTGCACCAGGAGATTATTCAAACCA
GTCCAGATTCTCTAAGTGGAGATCCCACTTTGAGTTTCTTTTGCACCAGGAGATAGAATATAAAATTAGGAGATCCCACTTTGAGTT
TCTTTTGCACCAGGAGATAGAATATAAAATTCTTCCTCTCCGATTTTTGGGTTTATATCTACCAACAAAAAAGAGACCTGGAGATAG
AATATAAAATTCTTCCTCTCTGATTTTTGGGTTTATCTCTACCAACAAAAAAGAGACCTAGAGATAGAATATAAAATTCTTCCTCTC
CGATTTTTGGGTTTATCTCTACCAACAAAAAAGAGACCTGGAGATAGAATATAAAATTCTTCATCTCCATCATCGGGTTCACCTCTA
CCAATAAAAAGAGAATAGAATACTCCAATAGGTATACGAGTCTAAACTGTTTCCTAATCTCAACAGGAAGTTTCTGAAGAATATCAC
TCAGAATATTCTTAAGAATAACCTGAATACTCCAATAGGTACACGAGTCTAAACTGTTTTCCTACCCTCAACAGGAAATTTCTGGAG
AATATCATTTAGAATATTCTTAAGAATAACTTGGCTACCTCCTAACGAGTATATGAGGTTAACTATTTCTCGAAAACTTCAAAAAAT
ACATGAGTATAAACTGTGTTCCAGCTTCGATTCAAGACTTCGACAACGGTCAAGCGATAAACGTAGCACCGGAAGAATTTTGTCTAT
TCTACAAAGCAATGAATAGACCAAAGGATGAAGAAGTCAAGAGTTGAAGCCGTTCACAAGTCCTTCTATACGATATCCTCAGTTAAA
TACTGAAGTGATTGCAAACAAAACCTGTCTCATCCAAAGTGTCCCAGACTCCTCTATAAAGGAATGAGTCTAGAACACTTTGGAGGG
GGTATCTGTAGGCATTAAAAAATGCTGAAAGATATTCAAACGCAGCTCAAAAGGAAGTCATCCAAAAATCAAAAAAAAGGACACAAG
TATAGACTGTCTCGCACCCGAGACAGTCTTTACTTTACTGTCTCGCCCATGCGAGATAGTCTTTACTGTCTCGCCGTCCGAGATAGT
GTTCACTGTCTCGCACGCGAGACAGTGTTCACTGTCTCGCACGCGAGACAGCTTTCAAAGGTTCAGAATTGTTTTATAACCGCCGAC
ACGTGCCCACCAACTGTTCAAGAACGTGGCAAACGTCGTGGGTGAGAATCACGTTGATAACTGCCAAGATAACGGAGTTTTAAAACG
TGGGAAGACAGTTACAAGAAAACTGTCGGGCAGTTGAAGATTTCCGAGACAGTATTTTCTGTCTCGGAACCCGAGACAGTGTTTACT
ATCTCGGAACCCGAGACAGTCTTTACTGTCTCAGCCGCCGAGACAGCAAATACTGTCTCGGAAATGGTTATTTGTTCAAGGGCTATA
AACACCCCCCTGAGATCGATAAACAGGGGGGCTGAGCATTTTTAGAGCAGATAGAGCAGAGTACTTGAGCTTCTGACAATTCCTTGA
GATTCGAGCTTTGACTTGATCTTAAGAAGAACGATCGTCTTACTTTGATAAGATCTTCGTTTCAAATTCTCATTTCGATAAACGAAG
GAAGAATCACTAAACCCCTCACGATCTGTGATTTGGTGGTCCACGGGCTAACGCACCCCCGGCACAGGCAAAGATCCCACGCAAGCA
GCGATCCAAACAACGATCATGCGTTTGTTTCTAAAAACTTGTAATTTTCCTTTTATTGTGTAAAAGAAGTCTTATAAAAAGGCTATT
TCTTTTGAATTTGTTGTAATCGAGCGAAGATATAATGAATTCCACAACGAGACCAACTTTTGACGAAAACACCTACCAATGATACTT
GCAATCTTGCTAATACATTTAGAATTCCACAAATTTAGTTTCAAAGATGGTAATTGAATCCACAATGGATAAATGCAATCATCAGAT
TTGTTAATGTCTTTACTAATAGACCAAGGTTTCAAAAAAAATAGGTCTAGACCCAAAAAACCATGGACCCTTACTTAGAATTTCATT
CATTTCATCTTCTCCCTTGAATTTGAACAAGAATAGACCAGCTTTTAGAAGACAAACTTCAGGAACATGAACCCAGACTTTGTTCAC
ATAGTTCTTCATTGCCTTAAACCTGACATTTAACCCCCAGACCTGTCCAATTAATAAGAATTTCCTCATTGAAGCTCCATCATTCCA
CTCATCTTCATTAAAAACAACTGAATCAGTTGCCTCAGAAGGCACATAATCCAATACCATACCGCTTCTAGGCTTCCTGTTATCAAC
AAACAAGCTGATCCAACTTTTGGCTGGTTTGATTTCACCTTCTTTTGAAATTTCTAAAGGGGGAAACTCTGAAACTATAGACTCATT
TGAAGCATTTATTCCTTCTTTCAAATTCAATGAAACAGTAACTTTATCAGCATCTAAATTTGAATTTAAAGATCGGTATAAAAAATA
GGTAAAGTTCTTGAAGACAAATAAAAGAGTGGAGGTATAATCTCTGATGCCGATTCATCAGCCCAAGAAACCCTAGCTGATTTCATC
CCTTCATTACAAGACAAAGGAGACTTATAGAGATTTTGAGCTTGAATTCCATTCAAAGGAGAAGTTCCAGCTTGAATTAGAAATGGA
TCAATCCAAGAATTTGCAGTATTCAGCAACTCCGCCATAGATTTCGATTTCTTTCCTCCCTTCGGACCAGTAGATCCCATTAGAGAA
CAATCTTCATCATCTTTATCAAATCTTGTATCAAAATGTTCATCAGAAGTGGGCAAATTTGAATTAGAGGCTCTCAATCCAATGCTT
AGGATCTTTTTCCCACTGTTCTTCTTCTTCCTCACCATCGAAAACTCGGCGGGGGCGCAGGATAACAGGAGAAAATTCGCCTGCTAA
CATGCACCAAAAAAAACGCCCCTTAGCGATCCCGACTAATTTACATTGTTATTAGATCCCTCAGATCTTATAATTTGCTATTGCTAT
TATTAACTTGAGAGAGAATTTGAAAAGTATAAGAATTGAGGGACTTAATATCGATTTCAATAACGAGGAACTGCTTTTGAAATAAAT
TATAAGAACTAGAGTTCTAATAACAATTTCAATTATTTGAGAAACTAATTTCAATATATTTAACATTTAAGTGACTAATATTTAAAA
AAAACATTTTTTATTTGATGGAATCAAATGATTCAAATTAAATTTGAGTCTAATTTTTCTGTTTTGGAAATCTTCTAGAGAAGTAAA
GACTTTCTAAGCATGAATTTTCTTACAGTAAATTCGTTACCTCTCCAATTACCTTCGAATAAAAAAAAACACAAAACTTTTATTGAG
AATTTTATTAATTGATGTGAGACCCATGTTTTCTGAACAATCAAGCGTAAGCATAGACATGAAAACAAACGAAAACAATTAATGCCA
TAAGATATTATTCCTAACTGTTGTAATATACTAAAGAAATGAAACAAGAGACAAGAGACAAGAGAAGAAGAGAAATTGTAATATTTC
TTCATCAATTCCATTTTCATACATCGTACAATTTATAGATACATGATGGAAGATAAAAGGACATCAAGTTAATAGTTCACATACAAA
GTAATGTCCACATAATTTTGTCTTTTAGATTTCAACAAAATGTCTTTTAGATTTTAACAAAATGTCTTTTAGATTTCAACAAAATAT
CTTTTAGATTTCAACACTTCCCCTTGTACATTACTTCGAGATGTCAATGCCTCGTTAAAAACCTCGCTAGAAAAACCTAATGGGAGA
AAAACTAGTCGAGGAAAAGAGTACACGACATAAGTAGATTCTTGTGTTTCATTAGTTGCCTCATTAAAAACCTTTAGCTAAGAAAAC
CATGTGGGATAAAACTTACTAAAGGAAAAAAAAGTGTACAACTATAGTCCTTCAATGCGCAATCTTCAAGGCACTCAGATAGGGAAC
TTCTGGCCCTCACATTTCTTCATTATCTTCTTTGGGCCTAAATAGGTCTTTATCCACTTCAAGGGACCGGACGACCATTTGTGTGCT
AAGTGAATGAGATTTATCTATATAAAATCTTTCCAAAGCTTTTTTCACGTAGGTCAACTGGTGTAGAAAAATTCCTTCTGGGAAATG
CTCGATCTGTAGGTCGAGACAAAACTTGGTTTTTCCCAAGTCTTTCATTTCAAACTCCGTCTTTAGGCATGAGCTAGCTTCTGTAAG
CTCATTGTGCATTTCAATAACATTTATATCATCAACATAGAATGAGATGATACAGAAGCCATTTTCGGATTTCTTTATAAACACACA
AGGGCAGACATCATTATTTTCATATCTCCTCTTCAGGGGGAACTCACTCAGTCGGTTATACCATATTCTACCCGACTGTTTCAAGTC
GTATAACAACCTTTGCAATTTAATACTATACATGTTGCGATTCTCGTTTTCTCTCAACTCAGGAATTTTAAGTCCATCAGGGACTTT
CATATAAAAATATTAGCGTCTAATGACACATATAAAAATGTGGTCATGATGTACATATACTGCATATATAAATTCATAATTTCTGCC
ATAGGTATTAACTTGTGGAACGTAATACAATCACTTATAGGAGAATATTTTACATCTAAATCGATGCCGGGTCTCTGCGTGAACCCA
TTGAGCTATGAATCTCACTTAATATCTCACCACCTTACAATTCTTATTTATTTTTCTTACGAAGACTCATTTATATCCTGCAGGGAT
ATATGGACTACAGGTTCAAAATACTTTAGTGAGTTCAGCTCAGCCTCAATTGCCACTTTCCATCTCACCTAGTCCGAGTGCTTCAAG

Fig. 13CR

CACTCTGCTACCGACTGGATCCAGATTATTTTCAAAGATAGTAAGAGCAACTGTAGAGGCAACTATGTTGTCGACAACTTTTATATT
TTTATTATATATTTCTCCTTTTTCACAAATTTGTGGCTACTTCAATTCTTATTTTATGTCAACCAAATCCTCGTCATTTCCCTTAAC
AATTGGATTTGGTCGTTCCGCATCTCCAGTATTGTGATTATCAAGCACGTGCAACTTTTCTGGAGATTCCATCTTCAGGATGAACCT
CTTCCGGAGGTTATGGGAGTGACTGTCTTTCTATATAGAATTTAGTTTGCCGCGGAATTTTACCTTTTACACTAACATGTTTTAAAT
GCTTCTGGCACAGTATGCTTCTGGCATACCAAATCATCAATGATATACACAACATGAATATGGGCTTAGTCACTCTTTTCTTAGCA
CATTATCATGTGAACTTCTGGTTCAGTTTGACTAGTACGTGGATATAAATATTGAAGATCTTTTTCACCAATGGAATTTCTTCACAT
TATTTTGTATTTTGGGCACTAATCTCTCCTTAATGTCGAGAATTGATCTTCAATAAAAAATACAGTCAACGTACCAAATTGTAAATTA
ATCCCCTAACATGGGCCATAGGTGTTAAATTATTGACGGAGTTTCATAAATAATGTATGTACCTTTACCGAGGTCCCATAGAGGCAC
GCTATGGTGGTGATATAGAAACATAGACTGCAAATAAAGAATACGCAGATGGAAAATGTTTCGCTTCTTCACCATGTATTAGATAAA
GGGGGAAATTATGATATGTAGTTGGTCGGATTTGGTTTGAATGCCTCATTTAATTTAAGGAAATCCGACAAATAATATTTTGCCCA
AGATGACCCAATAGTTCATGCCAGAATTTAAAAGAATTTGGGTCCCTAAATCTCAAAAAAAATCATCGCAACATGGTGTATTTTATG
TCATACAAATTCTAAAGTGTATAAATAAAAACCACATAGGTTCACAAGAGTTTAAAGCAAACTCAAGTTTATAAATAAAAACCACAT
AGGTTCACAAGAGTTTAAAGCAAACTCAAGTTAAATCAAAATTGTCTGACAAATGCATATAATCCAAATATAGAAAACCCAAATAGT
TTACCTTGACCACCTCGATAAGATGCACTTCAATGTCCACTACCTTCCCTAATCCAAGTTTATGAATATTAGTTTGAATTATGACAT
GTGCTTCAGGCACTACGACTGAACCAATTAAACTTACATTATGGTTTCTCACAACAGCTGGTTGTGTTTTTAACAACTACTAATGCA
AGTATTAGTTCATAATGCTTTTAGTTGTACTATTGTAAGAGTACAAGGTTACTTGTTGAATTGTATTCAGTCGAGGGTTTAAAATTC
AAAAATGGCTACAGGATAAGATCTCTTACTATCTTCATAGCCTCTCCCTCGTCCACGCGTATAAGTAATTTTCTGAATTATAGCATG
TGCTCCAAACACAACTCGTAAGCCAACTAGTCTAACATTGTGATTTCTCATCAATAATTTATTGTGATTCTCTACAACTCTAAATGT
AGATATCAAAGCAGAATAATTAGCATAATTTTTGATCATGTACTATTACTGGAGTACAATACTACTTGCATGGAATGGGAAAAAAT
TTGATCAATTCTGCGAGCTTCACCCGCTAGACAATATGGCACATGGTTGAATCATATTTAGTCATGTATTTAAAATCCAAAAAGTTC
TGATTCAGTTTGCCAGTTGCATTTGAGGGAAGATTATTGGCTTCCATAGATCAAAGCCGATCCTTCAGGGATTGCCCAGAAAGTGAAT
ACTTTTTCAGTGAGGCATTAATTTTTTTATGTCTTAATTGATAGAGAGAAAATTTAAAGTGTTTGCTTTCTGAGAAAAAATACTTAAA
GAATCAAGAGATATAATCGTGCAAAAATCACAAGAGTGTCCAGTAAAAATGAACGTTTGAGGTCAAAGACAAGTAATAATTACTATC
ATATATCACAGTGCACTAATCATGGCGACGAAAGATTAGTGCGTGAGAAATTAGAAATATTCACATTTTAATGAGATCACACATAAT
CACCAAAATCATTAAGCTCTTTTTTCTAAAGATTTTCATAAAGGTTATCTTTCAAATGTTTGCTTCTGGCAAACTAGTCTGATATTA
AAATTCACACGAAATTTTTAATGCTCGGACGATCAATGACCATCACAAACTCAAGCAAGTAGAAATTAAACAAAGGCATAACCAGTT
TGTGTTATCCTTTCTTCTAAACTCAAGGTTGTCAGATTCAAAACACCACCAAGGCAATTTTGGATAGAAACTAATATTGCATAATTT
CAGTGAGAACAACAATCAGTGCAATTAGCAATAAAAAAATAGACCACTTATGGACGCCAACATGAGCTTTAAAAACCCACAACTTA
ATTTAGCAATAAAAAAATAGACCACTTATGGACGCCAACATGAGCTTTAAAAACCCACAACTTAATTTCAAGTTGTTCATGAGGCTT
AGATTTTACTTCAAGCAAGCAAATAGAATATTTAAAGCAAAAGCATCAAGTTGATATATTATGACAATTTTTTCATGATTGATGCTA
TGGACCCTCAACTCTTTTCACATAGATTCATCATTTTTCATGATTGATGCTATGGACCCTCAACTCTTTTCACATAGATTCATCAAA
TGCCTCTCACTTAATTGGGAAAGAAATAAGCAATAATATGCATATATCATGATCCTAGGGACTAAGATAGAGTTTTCTTACAGGTTA
AGCACAACAAAAATCACTTAAAGCTTTCAAAAAACCAAATAAATATGTGCTTTACTCGTATAATAACCCAGCCACCTTAATGAAGGA
ATAAAGAAAAATATTCTAGTGTATTTCATACCTCAGTTTTTTTTCTTGAATCATCCCTCCATAAATTTCACCAAAAAATTAGGATAA
AGGTTTTGTTTTTGTTGTTGGTATTTCTTTCTCTCTAGCAACCTAACCAAGTTTATGTCCTTCTCGGAAAGATAAGTGGATAATGAC
AAGGATCTAACCTAAAGGGATAAACTTTATCTTATTGATGATTAATTTAGGTCCATACAACTAAAGAGCAAGCCTCCAAATACCAAA
CAGTCTAAAAGAAGAGTGCTGTAAAATTTGCAGCATGCTATCGAAATAAGCAACGATACAATAGCTACATAAATCTAAAAGAAGAGT
GCTGTAAAATTTGCAGCATGCTATCGAAATAAGCAACGATACAATAGCTACATAAAAGGACAAGTAACTAGCACAACGTATAAACAA
GTAGCTATTTGATCTCAATGGAAATTATAAGCAAAATAATCATATGATATGCATCAATCAAAAAGAAGGATAACTGTGAAATATGCC
CTTTATATCTTGTGTAACTTATTTGATCTCATAACAGTTAGATAAATACAAAGAGAAAGAGAAACATATATTCTGCTTGTATTCAGT
TACTGTGTTATGTAATATCTTTCTCTCCAAGTGAATAATGATGTATTTGAGAATCTGATCCTGTATTTATTTATTGTTTTGTGTAAT
CGGAAATAACCCTTTATCTTAGTTTCTTTGTATTTTCTGTTAAGACTTCCAGGCTATGTTATGACTGATCATCATGTGCATAAGAAC
TTAAAGATCACGGATCTACATGCTAAAGGTGTGTTTAGCAGCTGCATGCAAAATTGTTTGTTTTGAAGAATTCAAATAAATGAGATG
ACAAGATTCATACTGGACATAATCATAATCATTCGACGGAAAGCTTGATACTATGTAAATAGACAAAGGCCGAATGTATTATTACAT
TGCAGAAGATGTACACCTAAAAATCTATTACTACGAATCGATGATCACGAACCGGCTAGAGCTAGTTGTGCTGATAACGTGTTGTAA
TATACTAAAGAAATAAAACAAGAGACAAGTGACAAGAGAAGAATAGAAATTGTAATATTTCTTCATCAATTCCATTTCCATACATCG
TACAATTTATAGATACATGATGGAAGATAAAAAGACATCAAGTTAATAGTCCACATACAAAGTAATGTCCACATATATTTTGTCTTT
TAGATTTTAACAAAATATCTTTTAGATTTCAACAAAATATCATTTCGATTTCAACAAAATATCTTTTAGATTTCAACACTAACCACT
TAAATAAAAAAAAGGCTTTATGTAAATTTATCTTAACCTGATGCATATATTACGACCCAAATGTGAATAGAGTCTTCTAATCACAGA
AAACCGTAATTACTTCTTTCGCAAACAGTCTGGAATAGAACCCATTAACCCAACTTGGCCCATATGGTGGGCCCCCATACCCAGCGA
GAAGATATCCTCATCTTCACACGATCAGCAGATATAAAACAATCCTTTAGGAAATCGTCTCTCTTCTTCCCTAGATTCCTCTCAATA
TCTAATCATACTCCCTTTAAAATTCCATGGACTATATTGCTCTTATTCTTTTTTGATATTATATTCTAATCATAAATTAACTAAATT
AATTATTATTATTAATTAATCATATTACATGGCACTTCAATTTTGTGTAACTTGGCCCTAAAACTTCTAATGCTATTGTAAAACTCT
CATATTAATTATTAATAATGTATAATGCTATATTAGTAGACAATTGCAAGTTAATAAATTATTTTTGAATGAATAGAAAATATAAAA
TTATCCTAAAATTATACCATGACACTCACATAAGAAAATTGTAAAGAGTATTCTCGCGTACATAAGTACAAACATGCAATTTTAGAA
AATATTAGGATATTTAAATGCATTAAGATATAAGTGGAGGTATATGAGTGTAACTTTCGTAAGTTGTAAGGTATTTATGTTTAATTA
AGCCAATAAAAAATTGAAGCATTTGTTAACCACAAGCAATAGTATGTGATCCCTTTGAAAAATAATATTCATCGTATAATATGAGGC
GAATGTCTTAGCTTATATATATAGTAAAGAAGATGTGGAAAATTTTAAGCATCATATTTTGAATAAGTCTCAAGATTATGAATTATA
AATAAAATTATATACTTTGCTTAGAATTATGCTCCCTCTAAAAGAGGAAGTTATAGAAAATCTTTCTATGGTCTATATTACCCCTAT
TTTTAAATATTATATTTTAATCCTAACTAACTAAATTAATTATTATTGTTAATTAATCACATTATATGCCACTTCAAGTTTGTCTAA

Fig. 13CS

CTTAGTCCCTAAAAATTCTAATGCTATTGTAAAACTCTCACATTAATTATTAGTAATGTTTAATAATATATTAATAGATAATTGCAT
GTTAATAAATTATAAATGGAAAGAGTAGAAAATATAGAATTATCGTAAAATTATAATATTATATTCATATAGGAAAATTACAAATAG
TATTCCTACGTATAGAAGGTACAGTCATATAATTTTAAAAAATATTAGGATATTTAAGTGCAGCAAGATACAAGTAGAGGTATGTAA
TTAAAACTTTTATAAACTGTAAGGTATTTAATTTAATTAAGCCAAGAAAGATTTAAAGCATTTGTTAATCACAAGCAATAGTATGTG
ATTTTTTTGATAAATAATATACATCATATAATATGAGGCCAGATTGTTACCTTATATTTATATACTAGAGGAAATGTGAAAAAATTA
AAGCATCACATTTTGAATAATCTTAAGATTTTAAATTATTTCTGAATTCATATACTTTGCTTAGAAAGCTTTAGAAAAGGCTTTCGA
AGGACTAATACAAACTGTTGGACATCATATAAATGTTGGACAAATAAAATCCATGATATTGGATTGCAATAATCGGGTTATGTAAA
AAATATTTGGGTGTCATATGAGATAATGCTCATACATAATATAACATTATAATCTATTATTTGAGATATTGATGAATTTTTAACATA
AAAATTTACGTCAAGATATATGCTTAAGATTTAGGAGAGCTGAGAGTGGAGAGATTTGAGATATGAATTGTGGCTTTTATGACTTGT
GCTTTAGTTTTGGTTTCCAAACACGCCCAATACCAAGCCCACAATCAAATTAAAAATGACTCGATTTTGTTATACCAGCCAATATTT
TCGATAATGATCGATATGAGAAAAAATCCCCAAATAAAAGAAAACAATATAAAACTATAAATATTATCAAGATAAAGTATTTAACCT
TTCATATTAGTCGATATAGCAATATATCGACTGCTATTTCATATATTGCCTATAAGAGCAATATTTAAAGATAATTTAGATATCATT
TCCTTGATTTTAAATCTCCAATAATTCTACATTATTCTCTTAAAATTTTAAAATTGCTTATAATTTAGGGACTAATATTTAATTATA
AAACAATTGAGGGACAAATATGTAAATAGCTAAATTTAAAAGAATAGTTAATTTTTTAAAAACACTCTCAATTATGGGGAATGTCTC
AAAAAAACCACCCAACTAATTTAATTTGATAGAGCCCCCCTAACTATAGAGGTGTTGTAGATAACCCCTCTCAACTTTGGTACGATT
TTAGAGAACACTCTTCGACTTAGTGTGTCTTATAAAAACTCTTCTGGCTTTTTACATATCTCTTAACAAACCCCCATAATGTAAAAG
AGTTTAATATGTGATTTTATCAAAATACCATGTTGAAGAAAGCTATTTTAGTTAAAAAGAAACTCTTAACCGATAATAAAATGATTA
CGACTAATTTACAATTCTTTTTACCTCTAAATCTTTACTTTTCTTTTATCTAGCAAAAAACAAGCTAATTATTTTATGGTTGAGGG
ATATTTTGGCATTTTCAAGTCAAGTACTTATCACATAATGAATTCGACTCAATGATATTAGTTTTAAGGGGTTAATTGAGAAAAATT
CATAGGATTAAATCAAAATTTTGAAGTTGAGATAGATTAACTACAACACCCTAAATTTGACGAACAAAGATTTACTCATTTTAAGTA
GTTGGGGGCATTTTTTAACATTTTCCCCATAGTTGAGGGGAAGTTTTCTAAAATTAACCCTTAAACAAAGAATAATTTTACCTCGA
GGCTTTTGGAGATTCTCAACTGGTAGTTAATCAAATACGAGGGGAGTATGAAGTCAGAAATTGAGACCTGATTCCATACCACCAGGT
GCCCATCGAGATGACAAGCTCGTTTGAAGAATTTTTTATCGAGTACGTTCCGCGTCTCCAAAATGCATATGCAGACGCATTGGCTCA
AAATTTTGAAGTTGAGATAGATTAACTACAACACCCTAAATTTGACGAACAAAGATTTACTCATTTTAAGTAGTTGGGGGCATTTT
TTAACATTTTCCCCATAGTTGAGGGGAAGTTTTCTAAAATTAACCCTTAAACAAAGAATAATTTAAGATACATGTGACATCAATCTT
ATAAGAGTGGATTTTATAACGTCTATCAGTATCTCTAAAAAATATTTTGTTACAAAATTCGCAGAGAGAAATTTAATATTTATTTGTG
ATGCTTATGTGATCTTTATGGTTCTCCTTATCTTTTATGATTTGTAATAAATTATTTAATAAAATAAATTAAATTGTTCATTTTATA
TGTCACACCTTTATGAATCATATAGTTTTGATATGAGTATTATTAGTTTCTTTTAACTCTTTAACCTAAATTTTTGGACATTATTCA
ATATTGGATAGATCTAAATTATTTTGTTAAAATACAATCCATATGTGTACAAAATATGTTTAAATCATTCTCATATTATACTTTATA
GTTTTTTGAAATTAGAGAGTAATCATTTTGACAAATTAATTAATTAGTTAAGAAGATGTAGGAAGATTATAATATCAGATTTTAGAA
TTGATCACATAATTTATATTTTCTTTCTTGATTGAATTTGCACATCCTAACTTTGAAAAATCTAGAAAAATGTTTTTGAATATCTAT
AATACTCGGTCGCCAGATAATATAAAGTGGAAGTAAGCAATAGATACGAGGGATTTCTTTATAATTAAACAAAATCCTCTATGACCA
GATAAACCTACTATTTTACGTTGATGAATTCAAACTTTATTTTTTTTTATTAATAATAATAGTTTTTTAGATATTGCTGCTTACATCA
TTAATTTTTAAAATTAGAATTCCAAATAATTAAATTTCTCTTGGATCATTAATATTTTAAGACTTTAAACCTCACTAATTATATGGA
AGGTAAAGTGTTAAAACCAACAAGATTTTATATATTAAAATATCTTAAACTTTTTAATATATTATGATAATCATAAACTTTTTGCAA
CTATGTTATAGTAAATACATAAACTAAAAATCAACAATTATAATATTTGATCACATGCATTGCACGTGCATTCCACCTAGTACTATT
ATAAAAGTGGGTTGCCATGTTAAAACATTTATTCCCAAAATGCCCTCCAAAACACATGCATACATTAATAAAACACATACTTACATC
CTCCACAATACATGCATACTTAGGTACAACACATATATACATAAACATACATGCATGCTTAAATAAAAAATAATTATTTTTAATAAT
TATTTTATTAATAGTTTTCTTAATTAAATACCTTTATTCTCTGCATTTAATATCTTAAATGACCTCCTCCATCCACTCTCTCCACTA
TTTCACAAGTCTTTTCAATTCATACTATTACTGTTATTTTTATACATGAAAAGTAAAATGTAACTGTTATTTTTACATGAAAGTAGG
AGTTGAAGAGGGGTTCATTAGTAGTATAGTTGGTAACCTCAAGAAGAATTCAGTGATCCAATTAATGATAAAAAAACTCCTTCAACA
ACGTCTATTTTATTTAAGAGCTATATAACCCCCTCTCCATCCCCCAACACTCACAGCAAGGCTCACTCAAGATTATAACTAAAATGA
GTAAGTAATTTTCTTCTCTACCTCCTTGCTATTCATTCTCCTTTGCTCGGACAATGCAAATAGGAAATTAGAAGTGAAACTATTTTT
ATAGTTACCAACTAAATTTATTAAGTAGCTTTCCTTACTGGCCAAACTTGACAGTAGTGGTGGCGGCTTTGGTGAAGGTGGTGCCGA
TGGAAGAATAGATGGAAGGTCTTGGTTAGATGGTGGCGCCGGAGGTAATGATTGAAGGAGGCAGAGAAGATGGGTGAGGAGAGACAC
CGGTGGAGCAGGCAATGGAGATAGGGTCTGTTGTGGGGGCAATGGAGGTGGTGGTGGTCAAGGGGGAAGGGTCGCTGCCGGTGCCCA
TCATATGGTCGTGCATGTATGAATGTATGAATATTATTCAATTTAAGGTTAAATATGATGTGTTTGTTTGTTGTTGTATTGATAGAA
AGTTGCTCAATTATTAGGTTGCAATTAAACAAATATTGTGATTGTTTTGCTTTGTTTCTTTTCATGTATGGTTAAGTTGATGAGCAT
CCAATATTAAGTTAGGTGGACATTGACATACAAGGGCTGTTGTGGATTTGTACTGCATCAATTCAATGGATTATTTAATAGTGAATA
TAAAATAAATGAATTATTAGGACTATTAATATATTTGTTAATATTTTAAATTTTAATAATATTATTAGAAAATAGTACTAAATAGTT
TACAATACAAATTAAAAATTGAAAAAATTATAGGCTTTTTACGACATTAGTTCCTTAAATCTTTGATATTCTGAAACTAATCCCTCA
GTTCCTTAAATCTTTGATATTCTGAAGTACCTCAAATCAAAAATTTAATATCAAGTCCCTCCCCTAACCTATTTTGAATTAGTCCCT
CAAAGTATTGAAATTGCTATTATGCTTCTCAATTAATAAGTTAATTTGAAATTAGGAACAAGTGGCCAAGCTCCTTTGAGAGTTTGT
AATAAACTTGAGATTTCTTCAATTTTAATTTAAATTTCACTATGCACTTTCTATATGTATCATCTCTCTATTGTTATCTTATTTATA
TATTAGTACTATATTATTAGAACAATTAATTAATGTCAAATTTAAGATTAGTTATCAATTAGAAATAAATTGAATAGTTAGGGTAT
AATAGGATTTGAGTTAAATACTAATTAAAATAGTACATTTTTATTATTTAAAATTATATTTATTTTACAGATATGTGTAATATTTAA
TATATCACTATAAATTTAAAAATTAGAACATAAAACAAGTACAAATGGCTACGTGTAACGCACATGCACTATACTAGTTCTACTAAA
AGTTTAACTGTTATTTTTTTCTCTCACAATGTCTTTAGGACAAATTTTAAAAATCATCCAATTTACAAAAAAATCGCAAAAAAATGAC
CTCTTCTAAAAATAACTGTCAAAACCGACCTAGTTTCAGCCATCGGGTTGAAACTGGGTCGGTTCTGACGAAAAAAACTATGAAACT
TCATGGGACTTGAAGTCCCGTGAAGTTCAGCAGCCCATAATGATGTTAATCTATTAACATTAGGCGGTGCTAAACTTCACAGGACTT

Fig. 13CT

CAAGTCCCGTGAAGTTTCATAGTTTTTTTTTAGTCAAAACTAACTTTCAGCCTGATGGCTGAAACTAAGTCGGTTTTGACAATTATT
TTTAGAAGTGGTTGTTTTTTGAGATTTTTATGTAAATCGGATGGTTTTCAAAATTTCTCCATGTCTTAATTATTTTTAAGAATTAAA
GTCTTCATCATTTTTAAGGTCGGCAACGATCGAGGATGAGGCAGTTAACGGTGGCGACTTGCAATTTGAATCAATGGCGGATGGATT
TCGATGACGATATGAAGAACATCAAGGAATCAATTTTTAGGGCAAAAAAGCAAGGGGCTGTGATTAGAATAGGACCGGAGCTTGAGA
TCACTGGCTATGGTTGTGAAGATCATTTCCTGGAGCAAGATACTGTAGTTCATTCGTAAGTGGTTCTTCTCTTGGAAAAAGTGTTAT
TTTTTATAAAAATATTTTTTGTTTTTTCGGTTATTTACGTTGATTTAAGTCTAAGCTTAGCTTCAGTTTGTAAACTGAAAATTCAA
GTGGGGTTTTAAACCCTTTGTATTTTCTGCTAGCAAGGAGGATGCTTGGAAGACAAATTTCAATTATTTGCTGATGTTTGTTGCCTT
TGTATGCTATTAATTATATGCATTAGGCTTATTTATATACATGTATTTGACTGATTCAAATGTGTTGTATAATTAACTTAACTATAG
GGCCGTGATGATATCATGGTAAAAGCTCGGAAGTCATACTATGAAACTTTGGGAGAGGGTAACTGATCGAGCGTAGACTAAGAAAAG
AGATAAGTGTATTTGAAAATCAATTTTATTTTATGTCCGAGAGGTCTATGGACCATATACATATTTTGATATGGTTGATGGAGAGAT
ATAGAGAAAAGAGAAATGATCTATATATGATTTTTATAGTTATAGAAAAAGCTTATGATAGAGTGTCTAGAGAGGTAATGTGATGAG
TTTTAGAAAAAAAACATGTATTTGTATATATTGTGATATGATTAAAGATATATATGATAGGGTAACAACTAGAGTAAGAATTACTGA
AGGAGAGACTAAATCGTTTCCTATTACTCAGTAAGACCCCGTAGATTTTGATCATGTTTATGTGCATCAGTAATGGGTTTGAGTGTG
CAAATTTCATTATATGCAGCAGAACCATCATATGCAGTTTTTAGTCCATGAGTCGACCCATGATTTTCATGAGTCGACTCACGAAAT
TGAGTCCTGTTGCCTTTTGTTTCTGCTGAGTCGACTCATTATGTTACGAGTCGACCCAGGAAGTCATGAGTCGACCCATGACTGTGA
TGAGTCGACTCATTGAGGATTTTCCAATTTTCTCAGTTCGGGTTTGATGGGTTTCGGGTCGGGTTTTATCCACTTATATATATACTC
CCCTACCCGAAATCACCTCATTTCCATCAGTTTCCCCAGAAACCCTAGTCCGCCTCTCTCCTCTCTAAAACCCTAGGTGTTCTTGGA
GATTTTGGGGCCGTTCGAAGGCTTTCTCAGCGGCTTTGTGAGGATTTCAGAGAAGGATCTGTTCTTCATCATTTCTCAGGCGAGTA
ACATCTCGCCAAACCCCTCTCCCACGTTTTTAATAGTTTACAATGGTTTTCCATGAGTTTTATTGAGCCCAAGACTTATTTTCAAGT
ATAAAACAATGTTCTTGTTAGGGTAGATGCTAAAAATCATGTGTTTCGGATTTTAAACCCCCACCCACGAATTTTTGAAGAAAAACC
CAGATCTGGAAATATTTCTAAGAAATAAAAACATGAGTTTTCTTTTTGATCAAATGCCCTTTTTCATGTTTAGGGTAAATTGTTAG
ATTTAACACATAAGTAAATGTTCCTTATGCTATATGTGAATTTATCTCTGTATCATAGTCTAGAATTGATGGTTATAAAGATGTAGA
TTAGTGAATTAGAGGGAAGAATCGTGTTGGTGAATTTAACTTGTATTATATGCAGATTTCAGCCCGTAGGTCGACTCACGACTCATC
ACGAGTCGACTCATCATGTTGAGTCGACTCATGACTGTCATGAGTCGACTCACGAAGTCTTGTTGTGTTGCATGTTGTTTCTGCTGG
GTCGACTCGTCAGTATACGAATCGACTCATAAGCCATGAGTTGACTCATGACTGTCATGAGTCGACTCACAGAGTCCTTTTCTGATA
TCAAATGTGTTCTGTTGAGTCGACTCATATTTGAGTACGAGTCGACTCATCATAGTATTTTCTTTCTGTTTCGTTCATGCTTCTGTT
CAATTTACATGTTGGGTGTATATAAGTATTTATGCATACGGTGATTATGAATTCACCTGTTCATGTGAGATGATACTTTGAACACGA
GTTTAAGTCAGTACAGCAGAGTATGTACGGGAATATAGACATGTATACTTTTGGTACACAGTCCTCGTGTTGGACTATAATCCATTA
AAGTCCTCGTGTTGGACTATAATCCATAGAAGTCCTCGTGTTGGACTATAATCCATAGAAGTCCTCGTGTTGGACCATAATCCATTT
CAATCATGTATTAGACTTTTGCTAAACTTGAGCACGTTATTCAATAAAGTTGGATATACGACACATTGTATTTGGCCGGGACATGAT
AGCTACCTAGGTTGATCATGGCACCTATTGTAGCCTTGTTTCACTTACATGTTATTGCTAGAGATGGGCATGTTTTCCTTTTCCTTA
TTTTTCTCTTGTAACTAGCTTCGGGTTTTGTACTTAGGGATCTACAATTTGAGATACAAGGTATATACATGAGGGTTTCCTTGTTTG
GATTATTTCGCTCGACGTACCTATGCTCGTGTTGTATTTCCCTAAGTACTAAGACCCGTTAATGTTTGTATAAATGATTTATATTAC
ATTGTATTAACTGTATTTTCATATACAACGAGCCCTATCCCTTCGGGTTGGTTGTGATGTTGCTCGCTAGCGCTTTGACGCTCGTTG
TCCCTCCCCCCTTTCAGGTAACGAGACAGGAGCCCGGAGGGCCGCAGGTTGAGGACGACCCTTGCTAGTGTCTTTTGATCCTCTCAT
TAGATGTATTTTATTTTCTTTCTCCACTTGAGATATTTTAGCCTAGAGACGTATATGCTCTAGAGTTGTAAAGCCTGTGTGCCTTAT
TTTCCTGTATCAGTCATTATGTATTTTGAGGCATGTGAGATCTCCAGATTGTCATTTCTTTTCACTTCAGACTTGTCTATGCATTTC
AGTTTATTGTGTTGATGAGATGTGTTAAATTGATGTTCTATCATTGTACCAAGTTTCTGCTATAAAACCTTTTACTTGCCTATACCT
ACATCTGTTGTTGACTCCACTAGAGAGATAGTGATTGTGATGGTGAAACATGTTATTGCACGGTGTGGTGCATGGCAGGTTTGACAT
TCCCTGGTTTACCTCGGACTGCAGCCTTGTGTGAACCCAGGGGCGTCACAGTTGGTATCAGAGCTCTAGTTCCAGAATCCCTAGGAT
CATCCTGTGTTGAGTCGTGGAGCTAGGTTAGAGTTTCCTAGGATTCATGAGTAGAGTCCGCTAAGGATTTCCTAGTATGAGTGAGGA
CGATTTATGCGTATATCTCAAAATTTTGAGAATATTTTTTTTGGCAACTATTTTGCTTAAAGTATATGCTTGAATATTATGTGATGT
GAAAATCATATTGAGATGAACTATATATATACGTCTACTTTGACTCATGAACCTTATTTTTCTTATGATCAGAGAGATGGCAGGACG
TGGGAGACCCCGCACTAGAAGGTCCGCTCAGGCAGAGCCCCAGCAGGTCCCACCTGAGCCGCAGCCGGCTCCACCCGAGCAGGAGCA
GGCACCACCAGAGCCGCAGCAGGCTCCCCAGTATTTGGTGGATATCATGGCTCCCCTTATTGCCAGGATGATAGCCATAGAGGAGTT
GGTAACTACTCACATAGCACCTCGGACGCCACCACCGCCCGTAGCTCAGCAGCAGGGGATACCAGCCGTCCTGATCAGAGAGAGAGA
CCCAGAGGCAGCACCTGTACTTATTCCACTAGCAGTGCCAGATAGAGCCACGGACCAGGAAGCTTGGTTCCGTATGGTAGAGAGATA
CCAGAGGATGAGGGCACCAGAGTTTCAAGGGTCACCAGACCCTCTTGCAGCCCATAAGTGGAAGGAGGATGTGAACAATATCCTCGA
TATACTCAGTGTGGACCCGGTACAGAAGCAGAGATTGGCATCTTATAGCCTGAAGGGAGATGCCGGGAGATGGTACCGGCTACAGTT
TACTCCAGAGCAGAGGATGACCCTCACATGGGAGGATTTCATTTACTTCTTCGATGGGCAGTATATTTCTTCTGCAGCACGGACTGG
GAAGGAGCTTGAGTTGTCCCGGATGACTCAGGGGGACATGACAGTGGCGGATTATGAGAGCCGGTTTATGGAGTTGCTGCATTTCAC
GGGTATGTGGCAGACAGGAGAGCGTCAGGCTCAGATGTTCTTGGCTGGCTTCGGCCCTAATCTCTGACGGTATCTTGTGTCGAGGAG
ATTCTTTTCAGTCAGGGAGGTAGATGAGGCTACCACTTCTCAGGAGATCGAGACCACTATGTTCCTGAAGGACAAGGAGGGGAAGGC
CAAGGCAGGGCAGAGCGGGGAAAAGGGCAAGAACAAGAGACCTTTGTCAGCATCAGCATCAGCAGCAGTAGGGCCCTCATAAGAAGG
GACCCCAGCAGGATCAGCGAGCGCATCAGCAGCGCAAGTTCCAGGGTTCTTGTTTCAACTGCCACAAAGTCGGGCACAAGGCATCAG
AGTGTCGTAGTGCACCAGCAGGAGCTCAGCAGGGCAAGGGCCCGAACCAGCAGNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNN

Fig. 13CU

NNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNTTGATGAACCGGGTTTTTCGTCCCTTCTTA
GATCAGTTTGTGATCGTCTTCATCGATGATATACTCATTTACTCGAGATCGGAGACGGAGCACGAGGAGCATCTACGGATAGCGTTG
AGGACTCTTCAGGAGCACCAGTTATATGCCAAGTTCAGCAAGTGTGAATTTTGGCTTTCAGAAGTCAGATTTCTTGGCCACGTCATC
AGTAGAGAGGGCATAGCGGTGGACCAGGCTAAGGTCACAGCAGTTCTTGATTGGGAGCCCCCGAAGACGGTGACAGAGATTCGCAGC
TTTTTGGGCTTAGCTGGATACTACGGGAAGTTCATTCAGGACTTCTCGAAGATTGCGACGCCGATTACACACCTTACGAAGAAGGGT
GTACAGTTTATATGGAGTATGGAGTGCCAGCAGGCATTCGATATTTTGAAGACTAAATTGACTACGGCGCCAGTTCTGACTATCCCG
ACCAGTGACAGGACATTCGTTATCTATACAGATGCATCGTTGGCAGGCTTAGGACGTGTATTGATGCAGACTCAGAGGCTAGTAGCC
TATATCTCTCGACAGTTGAGGGTGCATGAGCAGAACTATCCCACTCATGACTTGGAGTTAGCAGCGGTGGTCTTTGCATTGAAGTCA
TGGAGGCACTACTTATATGGAGTGCAGTTTGAGTTATTCACAGACCATCAGAGTCTGAAGTACCTCTTTTCTCAGAAGGAACTCAAT
CAGAGGCAGAGGAGGTGGATTGAGTTTATCAAGGACTACGAGTTCGCGATTCAGTATCATCCAGGGAAGGCGAACGTCGTAGCAGAT
GCTTTGAGTAGGAAGCGTCGACATCGGTTGCGGCTTTGAGATGTTCATTGTTCAGAGACCTTATCACTCTTAGTCAGTTTGATTTT
AGACCCGAGGTTAGAGGAACCAGTGCATTTTTGGGAGCTGTGTCAGTGCAGCCATCTTGGAGTGACAGAGTTGTCAGAGCTCAGTCG
GGAAACTCTTTGATCAAATCCGAAAGGAGGAGATTTCCAAGGAGCCTAAGGCTGATTGGACCATTGGAGCAGATGGAGGCCTACGGA
TGAAGGGTAGGTTGGTTATGCCAGCTAGTGCAGAACTGAAGAGGGAATTATTTGATGAGGCGTACCGTACTCGGTACACAGTACATC
CAGGGACCATAAAGATGTACAAGGACCTGAAGAGACATTTCTGGTGGAGCGGCATGCGTAGAGAGGTTGCAGACTATGTGGCTAGAT
GTTTCACCTGTCAGCAGGTGAAGGCAGAGCATCAGAGACCGGCAGGGACACTTCAGCCCTTGCCTATTCCGGAGTGGAAGGGGGCGG
ATATTTCTATGGGCTTCATAGTGGGATTGCCGAAGTCAAAGAAGGGGAATGATTCGGTTTGGGTGATAGTGGATCGGTTGACGAAGT
CAGCATATTTTATCCCAGTGAGGACTACTTATACAGCCGAGACTTATGCGAGGATCTTCTTTCGGGAGATAGTTAGACTTCACGGAG
TGCCAGATACGATCATATCAGATCGGGGATCGGTTTTCACTTCGCACTTTTGGACGAGTTTCCAGGAATCATTTGGCACCAAGCTAT
CTTATAGTAGTGTTTTCCACCCACAGACAGATGGTCAGACAGAGAGGGTGAATCAGGTGTTGGAGGACATGTTGTGGGCATGTGTCA
TTGACTTCCAAGGCAGTTGGGAGGATCATATTCCACTAGCAGAGTTCGCTTATAACAACAGTTATCAAGCGACGATCGGTATGGCCC
CGTATGAAGCATTGTATGGCAGACCTTGTAGATCACCGATATGTTGGGCGGAGCCGGAGGACAGGTTGATGCTTGGGCCAGACCTAG
TGAGGCAGACTACTGAGAAGGTAGCTTTGATCAGAGAGCGGATTCTAGCCGCTCAGAGTCGGCAGAAGAGCTATGCAGATAAGAGGC
GAAGACCCCTAGAATTTCAGATTAGGGATCAGGTTATGCTGAAGGTATCGCCTATGAAAGGCGTACAGCGATTCGGGAGGCGAGGGA
AGCTTGCACCGAGATATATTGGACCTTTCCGGATTTTGGAGTGCATTGGAGCTGTATCATACAGACTAGATCTTCCAGCTTCTATGT
CTAGTATACACAATGTATTCCACATTTCTATGCTCAAGAAACACTTGCACGATGAGGAGCGGCAACGAGTGTTGGATGCACCGGAGA
TCGAGCTTAGGGATGATTTGTCGACTATTGAGATTCCAGTGGCCATACTTGCTAGAGAAGACAAGAGACTCAGGAACAAGGTGATTC
CATTGGTAAAAGTTCAATGGAACCGAAGTGGAGTAGAGGAAGCTTCTTGGGAGCGCAAGGAGGACATGCAACGCGACTACCCACACT
TGTTCGAGCAGGTAAAAACCGATATGACTTCTTACTTGAATAATTATATTATGTTTTGATACTTATATTTAACACTAGAATGAGGTA
CTTTTACTTAATTCTTAATCTTTCGGAACACGTGGTATATACATGGGGGTTCCTTGTTTGGATTTTTCGCCCGATGTACTAGTTCC
ACTAGATTAGGATTTGAGCGAGAATATTATCATTTAGATCTGCATCAGTAATGGGTTGAGTGTGCAAATTTCATTATATGCAGCA
GAACCATCATATGCAGTTTTTTAGTCCATGAGTCGACCCATGATTTTCATGAGTCGACTCACGAAATCGAGTCCTGTTGCCTTTTGT
TTCTGCTGAGTCGACTCATTATGTTACGAGTCGACCCAGGAAGTCATGAGTCGACCCATGACTGTGATGAGTCGACTCATTGAGGAT
TTTCTAGTTTTCTCAGTTCGGGTTTGATGGGTTTCGGGTTGGATTTTATCCACTTATATATATACTCCCCTACCCGAAATCACGTCA
TTTCCATCAGTTTCCCCAAAAACCCTAGTCCCCCTCTCTCCTCTCTAAAACCCTAGGTGTTCTTGGAGATTTTGGGGCGTTTTGAAG
GCTTTCTCAGCGGCTTTGTGAGGATTCCAGAGAAGGGATCTGTTCTTCATCATTTCTCAGGCGACTAACATCTCGCCAAACCCCTCT
CCCATGTTTTTAATAGTTTACAATGGTTTCCATGAGTTTATTGAGCCCAAGACTTATTTTCAAGTATAAAACAATGTTCTTGTTA
GGCTAGATGCTAAAAATCATGTGTTTCGGATTTTAAACCTCCACCCACGAATTTTTGAAGAAAAACCCAGATCTGGAAATATTTCTA
AGAAATAAAAACATGAGTTTTCTTTTTGATCAAATGCCCTTTTTCATGCTTAGGGTAAATTGTTAGATTTAACACATAAGTAAATG
TTCCTTATGCTATATGTGAATTTATCTCTGTATCATAGTCTAGAATTGATGGTTATAAAGATGTAGATTAGTGAATTAGAGGGAAGA
ATCGTGTTGGTGAATTTAACTTGTATTATATGCAGATTTCAGCCGTAGGTCGACTCACGACTCATCACGAGTCGACTCATCATGTT
GAGTCGACTCATGACTGTCATGAGTCGACTCACGAAGTCTTGTTGTGTTGCATGTTGTTTCTGCTGGGTCGACTCGTCAGTATACGA
ATCGACCCATAAGCCATGAGTCGACCCATGACTGTCATGAGTCGACTCACAGAGTCCTTTTCTGATATCAAATGTGTTCTGTTGAGT
CGACTCATATTTGAGTACGAGTCGACTCATCATAGTATTTTCTTTCTGTTTCGTTCATGCTTCTGTTTAAATTACATGTTGGGTGTA
TATAAGTATTTATGCATACGGTGATTATGAATTCACCTGTTCATGTGAGATGATACTTTGAACACGAGTTTAAGTCAGTACAGCAGA
GTATGTACGGGAATATAAACATGTATACTTTTTGGTACGCAGTCCTCGTGTTGGACTATAATCCATAGAAGTCCTCATGTTGGACTA
TAATCCATAGAAGTCCTCGTGTTGGACTATAATCCATAGAAGTCCTCGTGTTGGACGATAATCCATTTCAATCATGTGTTAGACTTT
TGCTAAACCTTGAGCACGTTATTCAATAAAGTTGGATATACGACACATTGTATTTGGCCGGGACATGATAGCTACCTAGGTTGATCA
TGGCACCTATTGTAGCCTTGTTTCACTTACATGTTATTGCTAGAGATGGGCATGTTTTCCTTTTCCTTATTTTTCTCTTGTAACTAG
CTTCGGGTTTTGTACTTAGGGATCTACAATTTGAGATACAAGGTATATACATGAGGGTTTCCTTGTTTGGATTATTTCGCTCGACGT
ACCTATGCTCGTGTTGTATTTCCCTAAGTACCAAGACCCGTTAATGTTTGCATAAATGATTTATATTGCATTGTATTAACTGTATTT
TCATATACAACGAGCCCTATCCCTTGGGGTTGGTTGTGATGTTGCTCGCTAGCGCTTTGACGCTCGTTGTCCCTCCCCCCTTTCATG
TAACGAGCCAGGAGCCCGGATGGCCGCAGGTTGAGGACGACCCTTGCTAGTGTCTTTTGATCCTCTCATTAGATGTATTTTATTTTC
TTTCTCCACTTAAGATATTTTAGGCTAGAGAGGTATATGCTCTAGAGTTGTAAAGGCTGTGTGCCTTATTTTCCTGTATCAATCATT

Fig. 13CV

ATGTATTTTGAGGCATGTGAGATCTCCAGATTGTCATTTCTTTTCACTTCAGACTTGTCTATGCATTTCAGTTTATTGTGCTGATGA
GATGTGTTAAATTGATGTTCTATCATTGTACCAAGTTTCTGCTATAAAACCTTTTACTTGCCTTGTACCTACATCTGTTGTTGACTC
CACTAGAGAGATAGTGATTGTGACGGTGAAACATGTTATTGCACGGTGTGGTGCATGGCAGGTTTGACATTCCTGGTTTCACCTCGG
ACTGTAGCCTTGTGTGAACCTAGGGGCGTCACATACTCTATGTTTACACCAAAGGTCAATCATAAGTCCTTATATTTTTGCATTAGT
TATTGATCAACTTACTAGGCACATTCAGGATAAAATTTCATAGTGTATGTTATTTACAGATGATATAGTCTTACTTAACAAAACTAG
AAGATGTATAATTTCTAAAGTAGAAAGGTAGATACAAGCTCTTGAATCTAAAGGTTTTAGAAATAGTAGAAAAAAAACAGAATATATT
GAGTCTATTTTTACTAAAACTAAGGAAAAAGAGCCTATAGTACATATTGATGGTTAAAAAATATTTAAAAGTAATCATTTTTGCTAT
TTAGGATCAGCCATTCAGCATAATAGTGAGATTGAGGATGATGTTGCCCATCAAATCAAATCAGGATGGTTGAAATGGAGGAGTGCT
TCAAGAGTTTTGTGTGATCGTAGAATATCAATGAAACTAGAGAGAAAATTATACAGAACGGTTAAAAGACCAACAATGCTTTTATGG
ATCAAGTGTTAGGCTATTAAAAAATATGTGCAAAAAATAAGTATAGCAATAATGAGAATGTTGCAATGGTCTTGTAGATATATACACTG
AAAGATAAGATAAGAAATGAGTGCATCCGTATAAAATTAGAGGTTGCTGCTATTAAGGATAAAATGAGAGAGAATTGACTGAAATGT
TTTGGTCATGATCTCTTATGCACCAGTTATCAAAATACTATCATGTTAATGATTACCTCTGATAGTCACTTCCTCCCAATTCCATCG
CCAATCATCTTCAATAAGATGACGAGACCACAAAACTATCATGTTAATGATTACCTTTAATAGTCAGTTCCTCCAAATTCCACCACC
AATTCTCTCCAATAGGATGACGGGTCCACAAAACTATCATATTAATGATTACCTCTGATAGTCAATCCTAACCCCCATTGAAAATAC
TTCATCAACTAGTGTTCTACCATGCGATGAACACCTACTTATCTCTCGATCAAGATAGTGATCTACCATGCAATGATTCACTATCTG
GTCTTCTCCGAACGTTCTATCTCCTTAGAATGATCAAAAATAGTGACATACCATGCGATGTGTTACTATTCCAATCACAGTCGTAT
ACTCTCATGTCACTGAACGGCTTGATTTCCCTCGCCAAGTAGTATTCTACCATGCTATGAGCACCTACTTGTCTCTCGGTCAAGATA
GTGATCTACCATGCGATGATGTGCCGCTATTTAATCATAGTAGTTATACATTCATGTCACTGAACGACTTGATTACCTCCACAATG
TCATGATGTTATTCGTTGATAGTGGCCTACCAAACAATGAGCCTCTATCATCCCCCTTGTTTCCAAATAGTGACCTACCATGCGATG
AGTCACTATTCATCAACGATACCACATCATCCCAGCAGGCCTACCATATGATGAGCCTCGTTTTCAGAATACCATGTTGAGTTGTTA
TACTGAATGACACAACCAAACTCTAACACTTAATCTAATGCCTTGAACGCTTAAGGATAGAGAAGAAATCTTAGCATTAAGCCTAAA
AGAAACTCATCGACAACTTACCATGCTAAGGGCAAAAGCATGGCTAGTCCAACTCAAACGGCCATTGATAAAGATACGTCAAGTCTG
TTGATAGCTGAGGATTTGCTAAAAAATCCTAGATGGCGATCATTAACTGCGTTTGGAGAGTTCAACTTTACCAGAATGGACAAGTTCG
CTGGAAGGCTCCTCATTTCATCTGAATAGTGCTCATTTTGCAGGCCTTAAGATCTAAAGTATTTCAAACCTTATGCAACCTGATTTG
GGTCTGAAAACTTTAGAGGAGGTTTTATAGGCAATAAAAATTACCTTAATTCCTAGCAAAGAAGCTCAAAATTGACAAAAAAACGCTA
ATATATCTCAAACCATAAGGAAATTAGTGAAATATACAGGAGCAAACCGAACCCTTTGGGGTTGGTTTGGTCGGCTCCGTCTCGTCG
AGATACTCAATTTTCATATATAATTCATCCAATTCTGACTTACGGTTTGAAAGTTATGACCCGTTCTTCACAGCATGTTCTGAAGTC
CGCATGTAAGACTAGACTTCGCATGAACATTAAAGTTTGTCGCAGTACTAAGTCCGCCTGCAAGACTGGACTTCTCCTGAACATTGA
AGTTCGCCTGCAATGCTAAGTATGCCTGACAACTTAGCTCGCCTGAACCGATTGAAGCTCGCCTGACAGCTTCGCCTACGAGGTTCG
CCATGCAGCGAGGCTCAACATCAAAAGACGAGGTTCACCACGTAGCGAGGCTCTACATCAAAGTTCATCACTATGGACAAAGCTACT
TTGGAAGATGAAGCTCATCATTAGAAACGAGGTTTGAAGCTCGTCATTGGAAACGAGGTTTGAAGCTCGTCATTGGAAACGAGGTTT
GAAGCTCGTCATTGGAAACGAGGTTCAAAGACTTGTCATTGGATACGAGGTTCGGACTCATCACCAGACGTAAAGCTCATTAGTGA
AGATGAGGCTCGTCAAAAGGAAATTCACAAGACTTGCTATGTAGTTGGACTCAGCTATCGTAGACGAAGTTCGTTGGTGAATACGAA
GCTCGTCAGATGATGTCAGTGAAAATAGAGTTCGCTATACTACAAAGTGGGTCTTAGAAGACGAACCTCGCTACATATTGAGGCTCG
TACAATCAGATGAACCTCACCATACAGTGAGGCTCTTCATCCACAAGAGATCCAGCTGTAACAACTCCGAAGACCTAGTCAGCAATG
TGGCTAAATCCAATGACTTAGTTATGCCACGGCTCCACGATTTCAGCGCATCACTTACGCCCTCTACCCATAATTTTAGCACATCG
GTTACGTGCTGAAACTCTATAAATAGCCGCAATCAACTATAAAGAGGGGACTTTTGGAGGGACAGACGGGAGGCAGAGCTTTGGCAT
TCAAGATTGAAATTCGAACCTTGGTTCTAACAATCTAAGCCATCAACAAAGTCTGATTCTCCTCTCGAGTTGAAGCGATCTTGATCT
GATTGTCAACAGGAAGTAATCTCAGCTTGAGCATCGAGAGAAGCATCCTTTCACTACCAAGAACCCATGTTAAACAAAGTGGAGCTA
AATTAATATTCTCTTCATCTGTAATCCAGAGAGTGAGTGATTGTACGAGATTTGTACTAAGTGATCGAACCCATTTCTTAAAACAAG
AGAATCAATCAAACATCAACTTTTCGACCCTACATCTACAACTACATTAGTCGCCAATACACAACATATTGAGTTCAATGTTATGGC
ATATGTATAGAGCATAAACATGAAATACATATAAAGAAGCATCACTCAGCATCACCTCAATGTTTTAAGTGAAATCTTCCTATAAC
CTCGAACCATAATCACGATCGTGAAAGCAGATGGACTGTTTTAAAAGGTGAAGCCATAGAGATATGATAAATGGAACTATAAGTTG
AACAAACACCCGCACAAATAGTCACAGCAGAGCACATCGCAATCAAAAGCCCAGACAGCAAAAGGGTATCTCTATTCATATGGTCT
CCAATCTACTCCACTTCAACAGAACTCCGAGCTGTTGAGCATAACCTTCGTCTCTCTCCCTGCATAAACCATTTCACTTTATGTTC
AACTGGAATGATAAATCTAGCGTGTCGATAAATCAAACATCAAGGTAATCTCTCCTGATAATGCAAATTTATATTTAACAAATGAAA
TGTGCTCATGATTTTCAAGCTAAGTTATTACGCAGTAGAATTGAGGGTCAATAATCTCCCCTTTCATGGTTAATCTATCTTTTTTGT
TTTCAAGCTTTCTCTAATCAAAAGCCAAACAAAAATCTAGACTTTCAAACGAACATGAAATTTCCATAAATCCACATATACATATAT
AATCCTACCATCAAGCAAAAACTGATAGTATAATTTAACTGAAACAACAAGGTAATCTCTCTCCTGTTGTGACGGAGTTGGCGAGGC
CATGGAGGAAGAGTCGGCGGCGGCGGACGGTGAAGGAGAAATGACCCAAACCCTAACTCCCCGTCACGGCGGAATCGGCAAGGCAT
GAAGGAGGAGTCGGCAGGGGCNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNATGGCTCTAGAGAGAGGCGGAGAGA
GAGATTGAGATTAAGAGGAGAGAGAGAGAGACATCACGATTGAATATTTGGAGAGAGAGAGAGAGATCATGATTGAATATTTGGAGA
GAGAGGGGGAGAGACACTTCTAGCTTATTCTTTTTTTTTTAATATGGGTTTTTTTTGTAAAACTACATCACTTTTTCTTCATTCCC
TCATTGTTAGATGAATGGCCAAGATTAATACACTTCACTACCAAGTTTTTTTAAAAAAATATATATATATATATATATATTATATAC
CCTTTAAAAGAGGGAGTTCCAAAAAAACTTTACCTACCCCAAATTACCCATCAACAAATGTAAATATACCAAAGTTATCCATTATAA
TCGTTACGCAGACTTCATCATCATCATCAGAAATCAAAAGCCATAAACTTACCGTAGGTTACGCCTTCCCTCCGACAATCAGTTCAT
CGGTTACGCTTCTCCTCAGCCAACGCCCTCCCACGATCTTAAGTCATCAAATGCCAAAGATGAGTATTATCGTCCTCATCATCAACG
CACCGCCTCTGTTATCATCTCACCAGTTCTCAGATTTTTGGCATCGGCTAGGATCAAGAAGGTCTCTTCTTCTTCTTCACTCCGCTA

Fig. 13CW

ATTTAAACTTATGAAAGAGAAATGTGATCTTTTTTGTTTTTGTTTTGTTTTTGTTTTGTTTGGTTGAAGTTTGACACTCTAGAATTC
AATTGTTTTTACAATAAACCCATTTGGTACCTGATTCCAATATTTCCAGTCCTACGCTACTCGAAGATTTATTTTAATCTTATGAAA
GAGAAATGTGATTTTTTTGTTTTGTTTTGTTTTTGTTTTTGTCTAGTTGAAGTTTGATACTCTAGAACTTAATTGTTTTACAATAGA
TCCATTTGGTACCAGATTCCAATATTTCCAGTCCTACACTATTCAAACTACAGAATTACTGATTTGAATTACCTAAAAGAGCTACCC
TGAGCCCTATTGGTATCAAGATCTTAAACTTGTTTGAAATAGCATAAGATGTCATCTGATTATTAACATACTAAAACCACATTTACC
AGACTGCTTTTACGTTAATTTGTTTTTAAGTTGTTCAAATGAAGAAATTACATTCTGTTTAGTGTGATTACTGAAACTATGTGATTA
CTAAAACTGTATTTTGTTTGGCATTGTCAGGTCCGGATGAAGGTCTGTTGTGTATTGGAATCAATTTTGAGGAAAAAGGATAATGAG
CATTTATCCATTATAGCATCTTATTTTAGTGAGAGGAGAGAATCTGTGGTTAAATACTCTGACGTACCTCAAGTTTCTTTGAGAGAA
AAGGCAAACAAAGTAAGTAGCCTCATTTTCCTTTTCGTCCCCTTTGAAATGATGTCCAAAGTTATTCTTGAATCTTGCTATATTCAA
TATGTCTTACTTTTTGCTCCTCAGGAGTGCTTTTTCTTGTGCATTTCTACCTATTTCCTTGGATTTCCTGTATTTGTACCTTAGTAT
TTTCATATCATATCCTTTTTAATATATTCAAGGTTTAATGTGAAAAATGGTTATTTCTTGTATATTCACATTCAATGATCTAACACT
TTGAATATGATTTAATCAAAATCCAACCCATTTTCAAGTTGATGGGAAAATTAGAGCCATTGTACTGTATCAGATTTTAAAATGATA
TTTATTTTCTACATTTCACTTTCGGTCAGCAGTTTTCTTCTATTGCGCTCATATTCTCTCTCTGGGTGCCACAAGGAGTACAGAACC
GGTGAATGGGATAATTGCTTGTGTTTATGTCTCAATATTTTAGCTTTCTCTTACCCTTCACATTTATTTGATGGTATTCTGTATAGC
AGCCAACCCCTGGATATAGGTGATGCACCAGGCAATCAGGATTGATGCTGCTTATCTATAGGAATAGTATGGAAAACACATTTTTCT
GTTGTGCCCGTTATAGATAAATATGACGTTCTATTGGACCATTTACGGTTCTTGGGTTTACTAGAATCTGTTTTTAGTTTTTATTTT
AAGTTATAATCTAATAAAATCTACATTCAAAGCCCAAAGCATCCAAGACTTATTAATATAGGCACACAAACAACTAAAATCTTATCC
TCTGAATCGATCGTTTATGGTTTTTCATCTTTTCCCTTGTTTACCTTTTTATAATAGTTCATATTTGCCTATTTATATTTGTTTGTT
TCATTATCTTTTTTTCTCTTAACTTTCCTGATCAAATTCCAGCTCATTTTTTTGTTTTCTCACTTTTTGTATGTTACTGATCAGTTTAA
TGCCTTCTTTTCTTTAGGTTTTAAGTCTTTTGGATGGGGACAAGATTTTTGGAACAGGGAACCAGGTGGAGCAATCTAACACAAGAC
CCATGCCAGTTCCAGCTGTTCAGATGCCCGACTTAATCGATACAAGTGATGCAAATGATTATGGAACTGAATCTTTAACACAGAAGC
ATGTTGACCAAAATATTGGAAACCTGACAACATCTGGTTCTTTGGTTGATGATTTGTTTGGAGATGGCCCTGTTGCTGGTCTGAATA
GTAGTGAAAATAGAAGTAAAGATGATCCATTCGCAGACGTATCTTTCCATGTGACCGAAGAGAAACAACTTGATGACATATTTTCAA
GGTTGACAGTTGATGTTAACAAATCTGAGAATGAGCAGAAAGTTAATAAAGAGTTTGGATTACTTGACGCTTTCAGTTCTAACTCTG
ATCTTCTTCTACAAGAATCAGAAACGAAAACAAGCAATGACCATGACTTGATGACTGGTTTGTCTCTTAACAGTAATGTGCTAGAGA
AGAACCAACCTTTTATTAGAACTTCCTTTGTTGATACCATAAATCTGTCCAGCCAAATGCCTACGAACCAATCCAGCCAGGGTACTG
TGAGCAGTGCTCTAAATGGAGGTCTTGGTTCAAACTCCCTATTCCCTATGCCTGCAATACAGTATAATATGCCCCAAACTATGATGT
TCAATCCATCTTATACTAACCAGCCAATGAACTATGCCGGCCATAGCGGCGTTCATTGCACAGCAGCAACTACTGTTTCAAAATGTAG
GAAATATTAATGCTGGTTATGGCATGCTGTTGACGGAAGTCACTCAGCATTACCTGACATTTTTCAACTTTCAAAAAATCCGGTAC
AAAACCATGCTACAACTCTAACTAGCTCGAAGGAGGATACAAAAGCGTTCGATTTTATTTTGGTGAGTTCATTCTTCCTTTACCCAG
ATAAATAAATTCTATTTCCTATTGATTTCCTCCTTCTGAAACTATCTTCTACAATAAAAAAGGATCATGCTAATAAACGTATTAGAA
CTGCTGGATTGTGAGATGAAAAGTTGTATGAATTTCACTAGGAGAAAGTACTAGAACTGCTGGATGTTGAGACGAAAAGTTGTATGA
ATTAGTCCAATAGCTGTCACACAGTTTTTTTGTTCAATTGCACTTTTTATGCATATAAATTGTCTGTATACTGTATTTTTTTAATTA
AGAGAATAATCCATACACGATTCTACAACATAGCTTCCATGTTAGTCTTAAAAAACTGTGTGCAAGATCCCAGCTGTATACAAGATG
AAACGTCGTAGTATTTTGGGCCAAGCAGTGTAAGTCATTTTCCGAGCATTGACTGCATTGTGCATGATCCCAGCTGTCATCTTAATG
GTCTTGCGCAATGAGGAAATTAAGGTTGTTGATAACAGATACGTCATTTATGCTAGCTACAGATCATCTACAGCTTTTGTGTTAGCT
AAAACTATAGGTACTAATTTATAGCATAACGTTTTATAACTGTATATTGATAAGTCCTTTTTTTCGGTAGGTACTTGGTGCTGGGTG
CTGGAGTTGCCGGATGTTACTCTATTCTCGGTATTGCTCTTGCCTTCTGTAGTCCAAGAAATCGATTCCTCCATGCTTTTGATATTA
TCTTTACTTCTTATTCTTTTTCCCCTCATCTTTTGAATTTTCTTAGCTATTAGAAAAATTATTTTAAGGGTAGCCTTGGCGCAACAG
TAAAAGATGTATTATGGAAACATAAACTATGATTAATATCTTAAACCTTAGCAACATCATATGAAGCTAATACATGAACTATGATTA
ATATCTTAAACCTTGGCAACTTCATATAAAGGTAATACATGAAAGTTTGATTTACACATATATAAAATAATTATTTTAAGATGAGTT
AACTATTGAAGTCCTATACAAAGATGTTAATATATGGAGCATTGTCAACCTATACAAATGTATTGGACCTACTGCTGTTACATTGGT
TATAGAGTTAAAAGAACACTTGATAGAAACCTTTTATATCTCTGAAGATGCTTGTTTTATGTTAAGGGTGTAAAAATTACCATTTAT
GTAAAGAGGTTTTCTGCCAGAAAAAAAATTAAACTATCTTTGCATGCCATTGTTCACATAACCTCTTTACAAAAAACTTCTATTAGT
GATTGGACTTGCCTTCTGATAGTGCTGTTACTTCATATGTTTGATTAACTATTAGTTTGAATCACTTTTCTTTTCTACGTATTTTTA
ATCTATCGAATGCAGGCATATTACATACAATTGTATTTAACAGTTAACACAACACTGGGACTTGTTCGGCCAAAATATGTAGATTGT
GAACCTTTTGAAATTACTTATGTGATTAATTCTCCGCCTTCAATGTACATGATATATAGGTCCTTCTGGTGATCATTCCAATAAAAT
AAAACTTGTGAACTTGTAGAAGAAAACTGAACAAACCAACGTAAGACAAAGTCTTGTTATCTTCACAAATAGTTCGGTAAGCATTTT
GATTCACTTCAATTATTATTTTTTGTCATAGGGATGCTTGAAAAGTTATGTTGAGCATCCAACTTCTTGCAATTATGATTTTTAGTT
ATGCTGATCATCAATCTTTGTAGGAATACTTAGATACCTTATGTATTGTGTATAACTATCAATTTTTAGTTCTTGCCTAAGGAGTTAT
TGCAATGGACTTGTTACTTAAATTTCCTAGACTTTCTTTTATACATCTCATAACTATCATTTAGAGCTTAAACAATTACCTCAAGCA
ATATGTATTTAATATAAATAAAGTAATTACTGTCTTAAGAAAGCTGATTAGCATTTCTTGAATTATATCTAGCTTGCAATTGATTGA
CAAAGAGTGAAAAGTGCAACTGAAAAAGCTTTCACGAGGTCCAAATCCGTTATCAGTCTTTGATATGGTAGTTCTTTTGCATTTACA
TTTTTGGTGAATTTCCATTTTCCAGTGTTTATTAATTCAACACATGTTTATCCTTATGCTTGTAGGAATTCTAACTTAAAATGAGA
CTATTGAGCTGGAAAATCTTTTAATCAATGCATGCATAACCATGAATTCAGTTGAAGCTAGAAAGGAGACTAGAAAAGCTCATGCCT
GTGAAGAATTTACAGTTAGATTCATTTCCCAATAACTTTCTAATTTATTTCCTTGACATTTGAGTTTGTTTCGTTAACATTATGTCG
CATATGTTATCTCAGAAGAGACCAAGAGAGATGATGAGAACTGGACGAAACACACGTTAGGGTTAGTAGTCATTTTCTCCTCTATAT
TTATTTGGATTATAATTGTGGTAAATCAAAATCGTTCAGTATATTAGACACTTGCTACACTATTATGCGCTTCAGACTCCACTGGGA
ACTGTTCTGTAGTATACACACCTGCGGACTATTTTTGCGTTCAAGTCGTGAATATGCTAGAAGTTTCAGAATATGGGTTTCTTGCA
TGATTGAAGTCTATGTGTAATGATATTACCCTGTCTAATGCATGTGTTTGTCTATGGTAAACAAGGGTAGATGCCATATTAATAGGC

Fig. 13CX

AGTACAATTTGTCATCACATTACTTATTAACGAATTATAAACATAAAATTCTCTTTATTTCCATTTCAACTTATTTGTTTCATCACT
TCATTACTGTTCTTCTTAATTCCCACTTATTGGGAACAGGAGTTAGGCTAGCATATAAACATGTTCATATGAATACTCTGGACAATG
AAATTTTACCGTCAACAACACGTTTAAAATCAGGGTCACTTGAATTTTTAAAATTATCTGATCACTAAAGCTTATAAAGTTCAAACA
GAAGGAATAGTAGTTTCTCGTTTCCTCAAGGATAGGAGAATGTAACCTATACCAGTTCGAGATGCTAATACCGCTGAACCATTGAAC
TGCATTTGAAGTTGAGGAAATTTTGATCCTGTGATTAATACACATACTTATAACAAATAAGAAACAGTTTGCGTTGCTTCTCCTATT
TGCAATGGACTTGTTATGATTTTTAGTCATGCTGATCATCAATCTTTGTAGGAATATTGTTTGGATCAACAAACCAAGGGTAAAAAC
TACAACTTCTCGTAGGTTCTATGATCAATTAGTTAATTTTTTTACATTGGCCAAAAAATATCTAACACATGATATTGCCTGTAAAGT
GCAGTTACATAATATCTGGGTACCGCTGCTAGCTAAAATTTTATCTGGCAGGACATAATGTAAACTTCTGGTTAATATAATAAGTTT
CCCTTACGTATTAACCTTGGAATCAGCTTACTAAATTTCTGATATAATCAAGCATGAGTATGATCTATTTTTCTTTTATTTGCTAAT
GATACAACCGAAGCTCTTTTATAATTCAAGAAATTCCATCTCTATGATTGGTTGCTTCCTCTTTCAAGAAATTAACAACCTGTTGTT
GCTTTCAAATGTTGTAAAGTGCAATTACATAATATCTGGGGCATGTTGCTGCCTACACTTCTATTTAACGAAACATATTGTAACATT
TTGGTTAATATAGTATGATGTGATTACCTATCAACCATGAAATCAGCTTATAAGTGAAATTCTAATATAACCAAGCATGAATATGCT
CTATTTTTCTTTTGTTCGCTAATGACACAAGCAAAGCACTTTTAATTCAAACAACAAGGTTATACCAATATGCTCCTTGTAAGTCTT
GATAATAAAGACTATTTAGGTAAAATTTGAGTTGTATATTCTTTTATAAAAAAAAAGAAAATATCGGATAGTTTTCATGATCAGGAAT
TTTGGTATGTTGATCAAGGGATGTTAACACCAGAAACCAATGAATCAGCCTCTTTCACAATGCAGTTTCAACGTCAAGAGGAGAAAC
GGTGGCTGCATGTACCCCATGTTCCTGCTGGAGGCCTTCAAGAGACCTCAAGAAAAGAAACTACAGTACAAACACTAATGCACAAACC
AAATCTTGAAGGCACAATGGCCATTAACAACAATGCTTTAGCTAAACTGGAAGTGCTAGGGTCCTTTATTGACTCATTACCTAAGA
TCTGATCTCCGAGACATTACATACTAACATTATATTTCATAAATTCGAAATTGACTTTCATTTTAAACTTTAGAATGCAAGAGAAAG
CGTATGTGATGTAATTTACAAATACTTTACCTCTGACTAGTTCACGCCTGAGTGCCTCCTATATTGCCTTGAGATCTCCTCTGAGCA
CCAAGCTCTAGAGATATCCAAACGTATAGAGGAGTCCCTTTATATATCACGTTGAAGAACAACAACAATGTCTAAAACCAATGCAGA
GAAAATGGAGTTGTTGGCTGATAGAGCTGAGAGTCTCTTAGTATGCCTGAAGCAGAGATTTCCTGGCCTAACACAAACCACATTGGA
CATGTGCAAAATTCAATTCAACAAGGTTTTTGCTTTGCTCATCTAATTTCTCACCTTTACATAATTCAATTTTCCTTGTAACTAAG
ACTTGTACTTCCAGAATATTGCGAAATCGATTATAGAAAGTTATTCCAGAGTCTTGGAGAGCCTTGCATTCAACATTGTTGCTCGAA
TCAATGATCTCATATATGTTGATGACTTAAGTAAGCATTCTGATCAGAAAAAATGTCACGGTCCCTTATTCAATTTCAGACTCTATCA
CTCCTTATGCTACTGCTTACGGAACTCCAAGCTTCTCACCGGTGCCATTGCTTAGCCTAGCTTGTGCAGAGAAAAACATCTTTCCGCA
TCAGAAAAGGTCATAATCATGGATTTAGTGTGAAAGTTTTGTCAGACTATCTAAATTGCGAAACGAGAGGGAGAAATGATAGCACTA
TTATCAACATTTCAGAATCGATCCCAAGAATGAACGAGTTATGATTCATCGAGCTCATAGTAAGATCATCCCATAACATGTACATGA
CATTTGTAATAAGCTTGTTTTGTGTATGCTGAGATTTACTCAAAGATAACAGGTTGCGTGTGTAAATATCACCCAATCAATCACTAAA
TATAATTTTATTGTTCAAATAATGAATTTTTAGCTTCTATATGTTTCATTCATTGTTTACATTCAATAATTTAATAACAAACCTTTC
CCTAAATAAAATTTAAAATAAATAATAAAAAAATTACCACGTGCATTGCACGTGCAATCTAACTAGTATATATATATAAGGGAGTTA
TGTGCAACTTACCCTTTAGTTGATTATATCTTTGCATTTTTATTTTTTCTACAGTTTTTAAAATCATATATTTTGTTTCAAGTCAAA
TTGAATCTTTGAAGATAAGTTATATAGAAGCCTCTCATCAATAATCAATTCCTCTAATTACCAACTTCCATAACTTTATTGATTGTA
ATACATCTCAGAAGAAACTTGTTCCATTAATGAGGTTATGTTACGTGGATTTACTTACTCATAAAGTAAATTTCATGACTACATTAG
ACAATAGAATAATGACACATGTACCGCCTGATTTGCTTAGACACTTGGCATAAATATTGCTCCTACCTTAGGTAAAGGCCTTTACAT
CCACTCGGTAGCACTAAACTTGCTTGATGAATCCTATTCTCTAAACCGCTTTTTTTTATCTTTGATAACTCAAAGTTTTTTTAACAC
TTTAATACCACAAAAATTATAAATATTTTAACTTTGATACCACAAATATTTGCATTTTTTACAGTGATACCTTAAAGTTTACCTATT
TTAGCTTTGCGACTCTAACCCAAGTTTGGGGTATCAAAGTGTCAAAAGCAAACCTTTATATGCCAAAATTAAAAAAGTATAAAATTT
GTCATGACAAAGTGTCAGAAATAAATTATATGGAATTATTGTAGATTTGAAGGACTAATATGGAATATTGTAGATTATGGGTATCAA
AGTTCAAAGAACTATGGGATATTAAAGTAAAATAGGGTGTTTTGGTCATTAAGGGATTAATGAGCAATTTCAAAGATTTAAAGGATT
AATATGGAGTTACTGTAGATTGAGGGACTAATATGGAATTATTCTAGATTTAAGGGACTAATATGTAATATCTATCTTTATTTGAGG
CTAAGGGGTTGTTTGGTTGCACACTTTTATAAAAAACTTTTCTCAAAATGTTTGACAATGGCAATTTTGTAATTAAAATTTTTCTTT
AGATTTTTTGTAAACTATATTTGGTTAAAAAAAATTACAGAAATATTTTCTATAAAATACCAAAAACTACCCAATTTTACAGAAATA
GATTTCCTCTCAAAATGGGAGGAAATCTTACACCATCCTTTTTAAATCACAAAACCCCTTCCCGTACCCATTTCCCCACGTGCTGA
TATTTCTTGAGCTGCTTCGAGGCCAGAAAATCTTGCTCTCGTTCGCGCATCAAATCCAGCGAGCTTTTGGTCCTTCGCGCCCATTAC
CGCTTACAACTCGTTCCCTCTCGTCCATCGCCCCCAGATCTAGGGTTCTCTCGTTCCCAAATCTCGTGCTAGGGTTTCATCTCATTC
CCAAATCTCGTGCTAGGGTTTCTGATCTCAAGGCTCTCATGGTAAATTCCTGTTCTTTTTGCTTATTTTTTTTGTGTTAATCTATTG
TAGTTGATCTATTAACAAAAAAATGGCTCTAGGGATCACTGAAGGATTCTTCTTTGTAATATACATGTAAATAAGATTAGGATAGAGC
TTCCCTTTCTTTATCAATGTTTCACAAGTAACTATCAGATCCAAAAAATAAAAGAGAGAAAATTTATGAAAGATTTAAATTTCAGTGA
TTTGATAAAAGCGGTTTTGCAAATTTGCTAGTTACTCTATTCGGTTACTTTTTTTGTTTCAACAATCAAAGAGAAAAGTCTACATTAT
TTTCATAGTTGGAGGATTATTTTCGTCGTTGGAGGTAGCTAAGCAGCAAAGGTGAAGTCTTTGTGGGTTTCTTTTAGTTTACAGATA
ATTTTGGGTTTTTGTTTCATTTTGTTGTGATGATGTTTTTCTAAGGATTTAAGAGATTTCTGTTGCTTTTTTGTTTTGTTGTTGTTGT
TTTTTTTTTTTTTTTTTTTTTAATTAAAATTTTATTCTCTATTTTACAAGCAGAGGCCGTTTTGTTTGCAGTTTGTTTGTGCTTCATT
TCTCTTCAGTAATAAAATCTTATCTATTACATACATAATAGTCTTTTTTTTTTTTTTTTTTGTCAATGAAAATTTCATTCATCTTCC
AAATATTGAAGGTTCAGCACATCAACTTCCTCAGTAGACTGAGATTACATGTTAACTAACAGCTACTCACATCCTCAAGAAATTACA
AAGTACTAAGCCATTCTTTGTCTTCCGCCGAGAAGGAGCAATTGAGGATATTAGATAGAATGTTGAACTTTATCTCCTTAAACAGTT
GAACAGCAGTTTTTCCTTCTTGTCTGAAAATTCTGGAGTTCCTTTCACACCAAATACTATAGATTGTTGAGGTGAGGGTCATTTTCT
TAATTTTTTGCTTGAAACCATTCCCCCTCAGTCTAAAGCAATACCAGTTTATAATCTGACTCCAAATGCAAGATCTCCACCTGAATT
ATAGCCAATTCATAACCATGTCCTAAACATCCCTTGAGTAGTGACATTCAAAAAAAAAGATGGTCCCTGCTCTCAGAACCAGAGCAC
CAGCAACAATTGTTAACACTCACAATCCTTCTTTTGATCAGTCTATCTTGTGTGAGCAAACGATCTTGAACTGCTAACCAACTGACA
AAAGAATGTCTGGGCAGATTTGAAGTTGCCCAAACTGCATTGTACCACGACACTACAGAGGCAGGAGGAGATAGAGCAGAATACAGC

Fig. 13CY

ACAGAGAACTAGATTTTTGAATTCCTGAAACAGTTTTGAATTAGTTGCATCAGATTGTCAGCACTTCCATATATTCTCAGAGCCTTA
TCTCTGACTTTCAAAAATAATTTCCACATTCACGAATCCCTACTCTTTGCTTGAATATGCCAAATATCATTATTCTTTAAGTATGTG
CCATGTATCCACTTAATCCAAAGACTTTCCTTGTTAACATGAATGAGCCAAAGAGTTCTTAAAGTTAAAGCCAAATTCCAGATAGAA
GCAGAATATATACCAAGACCACCTTGCTTCCTGCTCAAACAAGTCTTATCCCAAGAAATAAGAGAAATTTTATGAACATGCTCGGTT
TTACCCCACAGGAAGTATCTGCACATTTCATCAATCTTTTTTAGCACCTTAACAGGCAGAACATAATTTGCTTTCTGTTGTTTTTTG
TTAATGGGTCTGTGTTCATCTTATTTGGTCATAGTATTTGTATGTTTCTTGTTTTCTGGTCATATTTGTTAATGGGTCTATGTGTTA
ATGGGTCTATTTGTAGCTATCTATTAACGAAAAATCGTGCTAGGGTTTCTGATCTTTTTATGTTCGTAGTTGATCAATTTGTGGATC
TAGTTTATTTATAGTAAAAATATATTTTTTTATGATAGTTATGGTTAAAAATTTTGTTGTTACACAAATTCATAAGATCAAATTGT
ATTTTCATATGATAGTTATGATTGAAAATTTTGTTGTTAAACGAATTCATAAGATCAAATTGTATTTTCATATGATAGTTATTAGAT
GACACTTTTGTAGTTTCATTCCTGGTTCCACCACAATTCTTATGCTTAGGTTTTGGCAATTTGATCTTAACAATGGCCTCATGTCTT
ATTTTTGTTGCATAAACTTTAAAGTTTATAGACATCCACACATTGACATTTCAACTTCTTCCATGTTTGAAATTATTTTGACACTTT
GCACCTATAATTGTAATAAATAGAAGCAATCCTCTTCTTGTCATTGTGTAAGTAGTAAAAAATCATATCCAGTCTGTATTGCATATA
CTTTTAAAGCCTCCTTAAGCACCTGGTTGCTACCAAGTCTCAAACCCTTTTTCAATTCAATTAGCTTGTTAAAATCAGCGTCAAGGT
TGAACTCAGGTTGTGAACATCCTCTTCATCAGATTCATATAAGCTTTCTAACTCATTTGTGTTGCACTCACTCTCACCAGAATATCT
AGGTAAATCTTTAGAGTTCTCTCAAGTTTGGTGTATAAAAGGGTTTTGTTAATAAGTTAGTTGATAACTTTTTTTATCATTTTTTAT
TGTTGCAAAAACATTTTAAACTTTTTTTTGTAACAAATGTAGATGGATGGTGTAAATGAAGAACAAATAAAGAGAATGTGTGCTAAT
ATGACTATATCTTCCGTGGTTACAATAATACCTTGTTTATTGAGAATTCGTGCTAGGCGCAAATCCATTTGTTATGCTCCAAGAGAG
GATAAGATGAGGAAAATTTATTATAGAAATGCTCACTTCAAGCGCATCTTTGAAGGATATAGTGATAGTTGTAGCTCTTATATTAGA
ATGAGGCCTAAAGCTTTTTTCAAACTTGTGGGTGTAATGCGAAATCATGGTTTTCTAAAGGACACAAAATACCTTCAAGTTGAAGAG
CAACTCGCTATGTTTCTTTGCATAATGGGTCATAAAACCAAAAACAGAGTAATAAGGACTGAATTCATAAGATCGGGTGAAACTGTT
AGTAGGTACTTTAATAAGATTCTACAAGCTATGAATGGTCTTCGTGATTGATACATGAAGCAATCACCTAATGAAATTCCACCGGAG
ATTACCAACAATCCAAACTATTTTCCTTACTTCAAGGTAAGAGAGAAATAAATTATTTGAGTAAGTGATTTTCATAATTTAATGATA
TGAGATACTAATAATTTCAATCATTATCGAGTTTTGATAGGATTGCATTGGTATGATGGAACACATATTGATGCAATGTTACCCTCT
AACTAGTTGCACGGTTTAGAGGGCGTAAATGTGTAACACAAAATGTTTTAACTGCATGCACTCCAAATAAACTTTTCACATATATCC
TAGCTGGATGGAAGGTGCGACCAATGAGAGTATATGATAAATAGTAAATTAAATAATATAGACCACAACCTTACGGATTGAGAGTA
TATGATGGTATTTTTTTCATCTCAATTAACAAATAGTAAATTAAATAATATGATCAAACTAATCACAAATTTTCCTTTTATAACGTA
GGCAAATATTATCTTTGTGATGTTGGATACACTACCATGCCTGGCTTCATCTCTCCATACTGTTGCGTTCGTTATCACTTAAAGGAA
CAAATTGGTAGGACACCCAGAAATAGTAAGGAGTTATTCAATTTAAGACACTCTTCTTTACGGTCTAAAATTGAATCAACCTTTGGC
ATATTGAAGAATCGGTTTAAAATTCTTTTGGCAAAGCCTAATTATCCATTCCCCACACAAGTGGACACGGTCTTAGCATGTACTATA
TTACATAATTTTATTATAATTGAAGATCCACAAGATGACATCTTGAATGAGAATGTACTAATTGATGAGGAGAATGAGGATGTGACA
AACGAAGATGATACAAATGTAGTTGACTTCACTCAATCTAGGACACAAAGACAGGAGCGTGATTCAATAAATGAAGACCTTAGGGAC
CAAATTGCATGGCAATGTGGGTTGATTATTGTGCAAAATAAAGATGGCGACACCACAGAAATTGGCTTGTAGTTTTATTGTTTTTA
CATATTTCAGACTATATTTTAATATTTTATAATTGTGCTTGTATGAACAATGTAATTTCTTATATTTAATTATGTATTTTTTTTATT
TCATATTTGCACTTGTACGGATAATGTAATTGTTCACATATTGCAGCTATGTAATTCTAAATTTCTGGTTTGTTTTTATTATAACAC
ATAGGTATGTCTAACAAAAAGTGAGGAAAATAAAATTTGCCAAATTTACCGCATGCACCACTAATTGATTCAGGCGGTATTAATGTG
AATTTCGTTCCATATTCAAATCAACCACTCAATCCGCCTCATACAATGCCGCCTTCTTTCCCACATCTCCCACTATTAGAAGGGAAC
TATAGTGGAATGAGACAACAACATGTTTCATTCACTAATTCTTTGAACAGACCCCAAGGCTTGTATAATCCCACTTTGTGTTCTCAA
AGCAGCGGTCCATAACAAATGTCACCAACCCCGGTGAATCTGGTGGACATCAAAGCAATGTCATTAATTTGAGTCAAGAGGTGTTG
TCACCCTCTAAAAAAAACCAAAAAATGACTCAAAAGAGAAAAGTGTCTGCAACACAAGGAGCTCCTAGCCTCAATTTGAAGGGGGTT
TCTAACATGTGGTGGCTCCCCGAGCATGATGCGGAGCTTATACCGTGTCTTGCCAAGCTCGCGGATGCCGGAATTAAAGTTGATAAA
AACTTCAAAGCTGAGGCTTACAAAATAGCAGCTATGAAGATGAACATGAAATTCAAAACCAGCTACACCCACCTTCATGTGATTAAT
CGCATGAAAACTTGGAGAAACAAAATCAATGATATGAAGGCTTGCATCAACATAAGTGGTGCAGGTGGGAAGAGAAAAACTGTATGC
TAATCCTAGATGAGGAGACACTTAAAATATGGGCTCACGTATTAATTTTATCATAACAACACATTTAATTTATTTGGATGTGAGAAT
GTTATAATTAATTTCACACAATATTTTTCACATATTGCAAGACAAAAGGAATTCAAAGCTAAGAGGATATATAAACAAGTCTCTTCC
CTTCTACAAACATTTACAGAAGATCATGGGTGATGATCAAGCTACGGGTGATTTTGTTAGGCCAGTTTATGATAAGATTGGTACTAA
CAATGTCATTCCTCTTGATGATGATGATATGGACATTCCACTTGAGAGTGAACTTGAGCCACAGTCTGATGCTAACACTACCCCAAA
CTCCACTTCTAGAAAATCCCAACTTGAATCCAACACAAAGCCATCTTCAAGCAAGAGACCTCGACACTCCAATGATGATGAATTGAT
ACGTAGCTTTGTTGAGTCAATATTGGAGTCAATTAGAAATCAACACATTATACATTGGACTGAACAATTAGTTGCAGCTTTGAAGAA
CCATAGTGACTCCTATAGTGAAGAATTGCTTGATAAGGTTTTAAATCATTTGTATGAAAGTGAGCGTAAGGCTAGGAGGTTTTTTAT
AAAAACGAAGGAGGCTCAGAAGAGGTTATCATTTGTATGAAAGTGAGCGTAAGGCTAGGAGGTTTTTTATAAAAACGAAGGAGGCTC
AGAAGAGGTTTCTTGCAAGTCTTGCTTGAGCGTAAGGCTAGGAGGTTTTTTATAAAAACGAAGGAGGCTCAGAAGAGGTTTCTTGCA
AGTCTTGCGGCGGCTCAAGGATGGGACACGTCATAGTGCTTTGTTGTTCTGTGCACACAACACTCAATTTTGCTACTTCACATGTTT
CATTACTATTCCCTCACAAACTTATATTTTGTTAATTGTAAACTTTAGATGTTACTATTCATGTTGCTATTTCCTAAATACCTACAC
TAACTTATATTTTGTGTATTACAAAGTTGATGATGTTGCAATTCATGTTGCTAGTTGTTTTTGTTTAGTTCTCTATTGTTGGGTTTT
TTGGTCGATATTTGTGCTCGTTGTCGAGCTTTGGGGCTGTTTTTTCCAGTTAGTATGTTAATTCGTGCTTGTTTAGCTCTCTATTGT
TGGGTTTTTGGTCGATATTTGTGCTCGTTGTCGAGCTTTGGGGCTGTTTTTTCCAGTTAGTATGCTGATTCGAGCTTGTTTAGCTCT
ATATTGTTGGGTTTTTTGGTCGATATTTGTACTCGTTGTCGAGCTATGGGGCTGTTTTTTCCAGTTAGTATGCTGATTCGAGCTTGT
TTAGCTCTCTATTGTTGGGTTTTTTGGTCGATGTTTGTGTTCGTTGTCGAGCTTTGGGGCTGTTTTTTCCAATTAGTATGCTGATTC
GAGCTTGTTTAGCTCTATATTATTGGGTTTTTTGGTCGATATTTGTGCTCGATGGTTGTCGAGCTTTGGGGCTATTTTTTCCATTTA
GTATGTTGATTCGAGCTTGTTTAGCTCTCTATTGTTGGGTTTTTTGGTCGATATTTGTGCTCATTGTCGAGCTTTGGGGCTGTTTTT

Fig. 13CZ

TCAGTTAGTATGCTGATTCGAGCTTGTTTAGCTCTATGTTGTTGGGTTTTTGGTCGATATTTGTGCTCGTTGTCGAGCTTTGGGACT
GTTTTTTCTAATTAGTATGCTGATTAGAGCTTGTTTAGCTCTATATTGCTGGGTTTTTTTTGTCGAAATTTGTGATCGTTGTCGAGC
GTTAGGACTCTTTTTCCAGTTATTATGCTGATTGGAGCTTGTTTAGCTCTATATTGTCCGGTCCTGCTTCTGGTGGGCCGCCTCGAG
CATGGTCGGGCTAGGGATTTGGGTGGTAATGGTTCGATATGTGCGCGAAGGTGATTTTAGGAGTACTTCCGCAGAGGCTGCAAGTTA
TCAAGAAAGCAATTATGTTGTAGTAGGTTCAGATTATCTTGTGCATACGGATTTGTGTGAGTTTTATGATATTTTGATGCTCCAATA
GATGTGGAGATCTAATGACATGTGATGTTGTAGTTGATGTCATGAACTGCTGTGGTGAACAATTGGCAAGATGCTTAACATTGTATC
TTGGTAAGTATGGCTCTCAGCTTTTTAATGGAGAGCCTAGAAAATACCTAGTTAAAGCCTGATTAATGGGAATTATTTCTCTTTCACT
GCTATACTTTTCAGCAGTGCAAAATTCAGTTGCAAAATTTTGTATATGTGCATACTTGATGATGGAAGTATTTTATAAGATTTAATA
ATATGAAACAAAACGGTAAACTAGCCATTAAAGTGATAAATATGGTACTTAACACTTTTCTATAAATTTGGCATATGTAACCAAACA
AAAGAAAAAGAAATCTTGTTATTTTCTATAAAGTTATGGGTTATTTTCTTGTTTTGAACTAAACAAGCAAAGTACAAAAAACAAGAA
AATTGGTACTTTTGACTTCTCAAAACTTTTCCTATAATTTTTTTAAGAACTACAAGGAAATCATATATTGGATGGAAAATATTTCCT
ATAATTTCTAGAAGAAATTGAACCAAACACCCCCTAAACGTGTGAAGCTGAGTTCAAGTGAGGTAAAAAAAAAAAAGCAATGATAGGC
ATCAAACTCCGAACCACAAGTGAACGCGGGGGCTTCCTATCCTACCTATATTGCTGCTCGGCCTCTGATGTATGATTTTTAACTTT
GACCCTGTTGTCAGAGTATATGATACCACAAACAAAAACGCGTTTTGGACCCTTTTCATATAGAGAATGATATATGGATCCTTGTCC
GACATATGGGCCTATAATGGATTTGGAGATTAGGGTACTAGTTTTGGCCCGATTACACTCAGACACTTGATCACGGTCATTCTCATG
TGTTGTCTCTAAAATTGACTCTATATATGCATATGCCACATGCGTGCATGCTTCTCTACACGTGTGATGAGTTTGAAATGGACCTTC
TCCTATCTTTTACCAAAGTAGAGTTCATTTTTCTTTCTTTCACAAAAGAAGTCTCTTATTAAGGAACTTATATTGAGTATGAATTAC
TTAAGTCTCTTATCAAGGAACTTATATTGAGTATGGTAGAGAGTTCTTGTAGTGGTGACATGGGAAGTTAAATGGAGGGCTTCAGAG
CCATTAGGAAGTTCTTATGTCTTCCATTTCATTGATTAACAACACACAACTCTGAGGTCAAAATAGGCGGCTTTTTTTTAGGTATAA
TTTGAAAATCATGCTTGTATTAAGCTTGTATCTGCTAATTAACTTCAGTAGCATTGCTATTTGTTATTTAGATCTCTTGAAATTCGA
AGGAAGGTTATTTAATTAATAGTTAATAATTTTATACGTTGTAAAAGTGATGATCTGATTCGGGTACGTTCAAGCTTTGGAGCTCCT
GCATTTACTCTGATTCAAACTTGCTTACTGCAGTCACAGGAAATGCATCTCTATTTTTTGACCAAGTTAGGAGAACATTTTGGTTAC
TTGAAATTTTTAAGCGCTAAATCTCCATTTTTTTTTTCAGACTGCTTACACTTAAGTCAGATTTGCCTTCAACTCATCCACGTCGAT
TGGGGTTGGACTTAAACCTCTCAGCATTTTATTATGAGATCATGAACCCTGAAAGATAGGAGGTACCTTTTAAGAAAAGTTTGGCAC
AAACATACCATCAAGTTAAGCAATATAAATTGCAAGAATAAAGTTTCTCCTTCACCAAATAAAGCTTTGTTATTAATAATGTACCCA
AATAATACTAACTAAAGTTTCTTCACAAATAATGTACCCAAATAACACTTTGAATATTAAACCCTTCAAAGTGTATCATATTCAATA
GAATTTTTGATATACATACAATAAAAACAAAAGGAGATTTTTTGATTAAACGGTTAAAATACAAGGGCTGAATAAAAAAAAAGGCAA
TGTATTTAGGGTTAAAATACAAGAGGGAAATAATCCGGTGGGTTGAGACACATCCAAGTTTAAATTTTAAAGCCTTGACATAATTTT
CCCAGTTTAAATTCTTGATCTCCTAACCAAACCCAAAACAAAAGAAAAAAAACCAAAAAAAAGGAAGAGAGAAATCAAGAACAGGAA
GAGGGCGAAAGAGTGGGGGTTGGGGGGTGGGGGGTTCATGTTCGGGACGGTGTAGATGGAATGACGACTCCAGGCGTCTGCCATTA
GGGCATTTCTGCTATTGAGCCACTCTATATCCGATATCAATCGAGAAACCCAGGTTTCAAACATGTCGTTGAATCTTGATCAAGAAT
CTGAATCTTGGAACTTGGAGGAGAGAGGTCTGACAAGGGAGATCGAAGAAAGGTGAATGTGTCCGGGACGGTGTAGATGGAATGATG
ACTCCAAGCGTCTGCCATCAGAGCATTTCTGCTATTGAGCCACTCTATATCCGATATCAATCGAGAAACCCAGGTTTCAGACATGTC
GTTGAATCTTGATCAAGAATCTGAATCTTGGAACTTGGAGGAGAGAGGTCTGAGAAGGGAGATCGAAGAAAGGTTTCTCGATTGATA
TCGGATATAGAGTGGTTCAATAGTAGAAATGCCCTGATGGCAGACGCCTGGAGTCGTCATTCCATCTACACCGTCCCGGACACATTC
ACCTTTCTTCGATCTCCCTACTCAGACCTCTCTCCTCCAAGTTCCAAGATTCAGATTCTTGATCAAGATTCAACGACATGTCTGAAA
CCTGGGTTTCTCGATTGATATCGGATATAGAGTGGCTCAATAGCAGAAATGCCCTGATGGCAGACGCCTGGAGTCGTCATTCCATCT
ACATCGTCCCGGACACATTCAGAAGGATTAGCCCACAGATCCATAAGCCTTCAACGTGCAGCATCGGACCTCGGCACTATGCCTCTT
CCTGTTCTTGATTTCTCTCTTCCTTTTTTTTGGTTTTTTTTCTTTTGTTTTGCGTTTGGTTAGGAGATCAAGAATTTAAACTGGGAA
AATTATGTCAAGGCTTTAAAATTTGAACTTGGATGTGTCTCAACCCACCGGATTATTTCCCTCTTGTATTTTAACCCCTAAATACAT
TGCCTTTTTTTTTTCTGCCCTTGTATTTTAAACCTTTAATCAAAAAATCTACTTTTGCTTTTATTGTATGTATATCAAAAATTCCAT
TGAATATGATACACTTTGAAGGGTTTAATATTCAAAGTGTTATTTGGGAACATTATTTGTGAAGAAACTTTAGTTAGTGTTATTTGG
GTACATTATCAATAACAAAGCTTTATTTGGTGAAGGAGAAACTTTATTCTTGCAATTTATATTGCTTAACTTGATGGTGTGTTTGTG
CCAAACTTTTCTTAAAAGGTACCTCCTATCTTTCAGGGTTCATGATCTCCGTAATAAAATGCTGAGAGGTTTAAGTCCAACCCCAATC
GACATGGATTAGTTGAATGCAAATCTGACTTAAGTGTAAGCAGTCTGCAAAAAAAAATGGAGATTTAGCGCTTAAAAATTTCAAGTA
ACCAAAATGTTCTCCTAACTTGGTCAAAAATTAGAGATGCATTTCCTGTGACTGTAGTAAGCAAGTTTGAATCAGAGTAAATGCAGG
AGCTCCAAAGCTTGAACGTACCCGAATCAGATCATCACTTTTACAACGTATAAAATTATTAACTATTAACCAAATGACCATCCTTCG
AATTTCAAGAGATCTAAATAACAAATAGCAATGCTACTGAAGTTAATTAGCAGATACAAGCCTAACGCAAGCATGATTTTCAAATTA
TACCTCAAAAAAAAAGCCGCCTATTTTGACCTCAGAGTTGTGTGTTGTTAATCAATGAAATGGAAGACATAAGAACTTCCTAACGGC
TCTGAAGCCCTCCATTTAACTTTCCATGTCACCACTACAAGAACTCTCTGCCATACTCAATATAAGTTCCTTCATAAGAGACTTAAG
TAGTTCATACTCAATATAAGTTCCTTAATGAGAGACTTCTTTGTGAAAGAAAGAAAAATAAACTCTACTTTGGTAAAAGATAGGAGA
AGGTCCATTTCAAACTCATCACACGTGTAGAGAAGCATGCACACATGTGGCATGTGCATATATAGAGTCCATTTAGAGACACCACA
TGAGAATGACCATGATCAAGTGTCTGAGTGTAATCAGCCCAAAACTAGTACCCTAATCTCCAAATCCGTTAAATGCCCATATGTCGA
ACAAGGATCCATATATCATTCTCTATAAAAAAAAGAGTCCAAAACGCGTTTTTGTTTCTGGTATCATACTCTGACAACAGGGTCAAA
ATTAAAAATCATACATCAGAGGCCGAGCAGCAATATAGGTAGGATAGGAAGCCCACGTTCACTTGTGGTTCGGAGTTTGATCCCTAT
CATTGCTTTTTTTTTCTTTACCTCACTTGAACTCAGCTTCACACGTCTAGGGGGTGTTTGGTTCAATTTCTAGAAATTATAGGAAAT
GTTTTCCACCTAAAATAGGATTTCCTTGTATTTCTTAAAAAAATTATAGGAAAAGTTTCGAGAAGTCAAAAATACCAATTTTCGATC
ACCAGTGAACCCCCCTGATGGCAGACGCCTGGAGTCGTCATTCCATCTACACCGTCCCGGACACATTCACCTTTCTTCGATCTCCCT
TCTTAGACCTCTCTCCTCCAAGTTCCAAGATTCAGATTCTTGATCAAGATTCAACGACATGTCTGAAACCTGGGTTTCTCGATTGAT
ATCGGATATAGAGTGGCTCAATAGCAGAAATGCCCTGATGGCAGACGCCTGGAGTCGTCATTCCATCTACACCGTCCCGGACACATT

Fig. 13DA

CAGAAGGATTAGCCCACAGATCCATAAGCCTTCAACGTGCAGCATCGGACCTCGGCACTATGGAGATCCGAATCTCCATCCTATGCA
ATGTCATAAACACAGGGCCTTACAGAACTTCCTCGTCCGATGTCGAGTGTCGATCCATGACATCATAGAAGCCCTGAACAAGAACCT
GCACGACTTCAGAGCCTGCTATCAAGATCTTGATACATTTTGGATGAAAAATGATGATGAGTTCCTAAGAATCATGCTTTATGATGG
AGCATTCATGATCGAAATAATGTTAGCGACCTTTGAAACATATGTGTGCCCACCTTCTAGTTATCACGCAAAGGACCCAGTATTCAA
AAAACCATACTTGGTTGAAGATCTTCGTGTAGATATGCTCAGGTTGGATAATCAAATTCCAATGAAGGTCCTGGAGATATTGTCTGA
ATTCTGCAAAAACAAGGTGATGAATGTTAACGAAATCTAAATCTTCATACCTTTAAATATCCCTGTTGTAACTCCAAACTTGCACAA
AATTTTCATACCTCGTAATGTAAGATTAACCTAACAGTCAACATTGTATAAAATGATACATTATGCAATGAGGATACTCCCACAAAA
TTTGCTATTCATTGATCAAATCATTCCCATGAGAATTTTTTGCAAATAAATGAGTAATGTGCATGCTCAAGATAGCAGTCACCATAT
TGAAATCCAGCAGAAGACACTATTTGCATACGCATCATATAAGCTCTATTGAACTAAGACCTGGATAAATAACTTCTGGATAGATAA
ACTTTTTTCAAATCCTGCAGAAGACACTATTTGCTGTAAGTGTTGAACTTTGTGTATGGATCCCTTTATAAAGCAATCACAATTTAT
GCTGTTGCTTAAAGTAAATAACTTTTTTCTGTCTTCCAGATTCAAAGCATTCACCAGCTAATCAGACATTTCTTCTTCCACAAATAT
GAAGAGGGAAGATATGATATTAGCCAAACCTCTAGGATATTTCACCTAACGGAGATAACAGGGCATCACCTGCTGGATGTGTACAAG
AAAACTGTTATACAGAATGGAGGTTATCATCACACCAACAGTCGCTAACCACTATCGGCAGTTGAACTACAGGAGGCGGGCGTAATT
TTCCAGTGCAGTGAAACGCCATCATTAACAGATATAAGCTTCGCCAAAGCTGTCCTTTGCCTACCTGCAGTCGACGTTGACAAAGCA
TTTGAAGTTGTTATGCAGAATCTCATTGCCTATCAGCAAGCACATGGCGAAGGTCAAGAGGTAACATCCTATGTGTTTTTTATGGAT
GGCATTGTAAACAATGACAAAGATATTGCCTTGCTTCGAGAGAAGGGTATTATCAGGTCGGGAGTAAGCAGTGATAAGAGGATAGCC
GATCTTTTTAATGGACTGACAAAAGGTCCAGTTCCAAAAGTTGTCGACAATGTTGATGTTGATGTAACCCAGGACATCAATGACTAT
TGCAATAGAAGATGGAACAGGTGGCAAGCCAACTTTAAGCAGAGATACTTTACGAATCCATGGGTAACTTGCTCACTCATTGTGGGA
GCTCTAGTATTAGGTCTCACCATTACTCAATACAGTATATGATGTCCTTTCTTATAATAAGTGAAGTTAATGTAACTCTCATACTCG
AAAATGTATGGATGATTCCAGTCTTGATCCCAGTCTTTTGTCCTGGCTGTGTGGCCATTGTAAGCATTGTAATTTGAGACAATGACA
AGGATGAATAGGCTAATATCAACTGAAAAAGGTTCATAAGGCAGAAGGAAAGTTGTTACGAGAGTTGAGGGTTACATTTTTATACTC
TAACATGACCCTCCAAGTGAGCGCACACTTTCATGAGCTGAATCTGGACTTTTCTTGTAAAATCCACTTTAGAAATTCAAAGTCAGT
AAAAATTGAACCTGGCTTACTCTAGTAACATGTCAAAACACAATGCCAATAAAGCAAAACTCTGAAGTTGTGGTGAGGATTGAAGAT
TACAATTTCATATTCTACAATTATAAACCCAAATAACCCAAGCCATCTCTCAATAACTGTCTCTGTGCAGTGACACACAAAGGTGAC
TGACACCTTGGCCAGTTTGGAAGTAATGATGGTTGTCTTTAAGAACTTTGATATTCTGTAATTCTAGAGTCCTTGGGTTTGACTTTT
GAGTTTCAATGGTTTCAATAATTCCTGACAGAAACAAGGCCAAGAATCAAGATCTTTTCTGAACTAGGTTTTCCGAATAGATCTAGT
AACAAGTGATCCCAAAGGATGAATCAATTTCTGCCTAAACTCCAAAGGGTCCGATCAAAGGTAAGAGAAACAAATACGAGGAGAAAC
CGAACAAAGAACACCCTGGTACTGAGAATCCCCTTCCCAAATTGCTACCAAATGCAAAAACTTTTAGAGCTTATGACGAGTTCCAGA
TTCAGGGTTTTTCGTCCTTAATTGAACTTGAAACCAATGGGCTGCCAATCTCTTGGTAATTTCCCTAAACCTAGTTACATTCACTTG
ATCTATTCCTCTTTTCTAAAGCAAATATCCCTAGATAGCATCTTAACACTTGAAAGCTGCATAATCTTCCTTTCAATTCAAAAAGCA
AAATACATATAACTGAACTAAAAGTAGAGACATTGTTGGTAATGAAAATGAATATATCATCTTGATCTTCTTCACAAATTTGATTA
TTTTCCTCACAAGTCTATCCCATCTATTCATATATTAATATTCCTCCTCCAGGGTTTCCAAATTTGCGCACAAATTCCAACAAAGAA
GTGTCTGGAACAAACACCAATCTAAAGTTACAAAAAACTGATGTTTCCTGATACATACAATCATCTTGTTGCTATTGCTATAATTAG
GCATATTAGAAATACTAGGAAGCATGAAGTAGACAACAAGAAGAAAATAAAATGAGGTTTTAATCTCAATCATTAACTAACAATAAT
ACAGATAGATCAAAGAGGAATTAGAGAAAAAGAGGAGAAACATTTTACTCGTGATAAAAGAAAAAGTATTTTAGCAGTAACACTCTT
CACAAGTCTATACACCCTTCAAAACCCAGCTTTTACATGAAGCAATCACCACTCTTACTTTCCAAGACCTATTTCACCCTTTTCATC
CTTCCTTGAGATCCCTCACCAAGACTAAAAAGGATATATAAATAAATAAATAAAAATAGAAGTTATAGCATTTAAAACAAGCATGCA
AACAATGTCCATCCGTAATTTTACAGATGGATATGCNNNNNNNNNNCCATCCACTATTCACCAAAAGAAGAAGGAACATGAGACACA
CCCAATCCTTCCTTTACCTTCCTCTCATTTTCCTCATTAACCTCTTTGTAGCCCTTAAGACAAACAGAGCAATCAATAGAGAAATAA
AAAGAGAGCACATACAGGAATCGCCAAAGAAAGAAAAATTCACTTTTGAGGTCTGTTGCATATCCACAAGCTCCATGCCTTGCACAA
AAGTCGGAAAGAAGAAGGTAATGTGATACATATCATTTCAGTCTGTCTTAAAACTACCCCCAAAGCCTCTTAATCGAAACATCCGAC
AAAGAAGGTGACCTAAAACATATCATTTCAGTCTTTTCCCCATGATTCATCGTGTGGGTTTGTTTAAGCTCAACGTCTTCCATTATA
CAGTGTCTCCCTTCTGTCTCTTATTATATCTCTTCTATTTTTCCCCTTCCATTCTTGACTTATTCCATCTTTTCTTTTGGCCCTTCC
GTATTTCATTACGCTGCTTTTCCGTTGACACGCATTCATCTCTCATTATGCCTCCCTCTTCACTTATTACATCTTCTCTTTTGGCCA
TCCCATCGCCCTCCCTCTCCCTCAAAAAACACACACACACACACACACACACAAAGAGGCAAAGTCCCTCCCGCTCTCCTTCATTCACC
ATAATTTGCTCATGCTTTCATCTCTGTTCCTCCATTTGTTGTTGCGGCATAGCAGCTACACTTCTACCATAAATTAATGTGATAAAG
ACTGGATGTAAATGAATTCTTACTAAAGCACTCATACATTCTTCCTATGCAAATATTCTAAAAGTATAAGCCTATTGAATATATTC
TAAAATAGATATAGTACAAAAACAAAAAAAAAATTAGTTTATACCATATATTCTAAAATAGATACAAAATGAGAAGTTCTTTTGTTT
CAGATTGATCCTGACCAATATTTCAGAATGTCCTCCTTTATATTACCAGAATATTGGACACCCCATTATAATGTGTTCAAACCATAA
CTTCTTCAAAATGAAATACAATGTTAATTATTTCTTTATGCATACTTCAATTACTCTTGGACTTTGCCATTAAAAGAGGGATCATGG
TCTTAGGCCAGTTTTGGCAAATGTTTACGAAGGAGGATTAAAGAGAAGAGTTAACATATAGTTAGCCTTATTGTTAATGTGAAGGGC
TAAATTTGTTAATCTGTGAGGTTATTTTATTTTAATCCTTATTACCATTTTTGTGTTTGGAAATAACAAGAATTATGACCACTTTCT
TTATAAAAAGAGGGGTTTATCTCTTAATCTATCTAAATATGTGGATATGTAAAACCCTCGTTTTGAGGGATTAACTCATGTAATCC
CTCTAAAAGTATTTGTAAACCCTTCTTCTATATTTTGTGCTTGGCAAATTAGGAGGGGTTGACTCAGTTCACACNNNNNNNNNNNN
NNNNNNNNNNNNNNNNNGTCAAATCTCCTTAACCCTTCATTTACCTATTTGCCAAAGGAGGTCTAAAGGTTAAGACCGTAGGTCATAG
CAGTATGCCACATTTCTGAAGCAACTGGAAAGTGCCACATTTTTGAAGCAATTAGGGAAATAAAATGGAAACAAGTGTGCCCTGGA
AATCTTTCTAAAATTCAATTAACACGAAATATCCTTCAAAAAGACTATTTCCCCCTTAAAGACACTATCACAAAGCCTACATCATTG
CCCTTTGAAACTCTCATTCCATTTGCAGTATATTCTAAGTGATGGTACAATATTCAAATTCAACATCTTTTCCAAAGTTCATGCTAA
AGAAGATCACAGAGTTGAAGAAATTCAACATCATCCAAACTTCAATTCATTCAGCATCTTCCCAAACTTAAATTCATTACATAGAGG
CCCCAGCGCTTCAAATTTGACACCCATCCCGAACTTAAATTCATTTCATAGATATCCAAGGAAGTCATTTTGGTGGCAGACAAAAAA

Fig. 13DB

GATTCGTTTTTCTTGTTTTTAACCTGAATATTTAATTGCCTGTCAAACCCACAAAGAAACCTAATGTTTTGAATACATACCCACCAA
TTTATGTGTTCCTCTTCTGACCCTCTCAAGAGTCCATGTGAGGATGATAGATGCAATTCACTACTAAATTTCATCCAAAAATGTCCC
TTCACCTCCGATTACAATTGGGAATGATTGCATAAATACAGAGTCATGAGTGTTAGCAATGTTTTCTACAAATCTCATGATTTAAAA
AAAAAACTGCTATTTTTGCCAATATTACACTGAAGAAAAAAGCAGAATGACACTGTCAGAAAGGACAAATGGATCACAGAACCATTC
ACATAAAAATGAATTAGCACCAGGTGAAGACATGAAAGGTCTAGATGAAGTTTATTTACAATGTGAAAATAATAATTTACAATTTGA
GTAAGTGTTACACATTTGCATATTGTAGAGATCATGCAGCATCTAAATGTGAAAGCCTTAGACCTTGCAAGATCCTTACCCAAAAAA
ACATATGCAAACAAAGAAACAATAACTAGACATAAATACGTATGTATGCAAGAAACTGCATAAACACAAAAAGAAAGAAATATATAT
ACAATGCAGAGGTGAATTCTATACAGTTTACGCTGCCTCTGAAATTTTCAGCCTAAAAAAAATCTCCCTGTCCTCATGCATCGCACG
TGTACAAAACAATGCCATCCTACCAATGACATCTTGACACGTCATTACTTCTAAAAAAGAATGGTCTATATCATACATATAGGACTT
AGAACACGGTGATTGCATACAAAACATGACCCTGTTGGCTCTATCACTCCAGCTCCAGCTGCATAACATTAATAAAACCCCAGCTAC
CATACCTAAAGAATGGAGGGTATGAACTAAGGAGTATTCTATAGAAGGGATTTGACAAGGTTTCTACAGATCTAAATGGTCAATGGT
AATTACAACCCTTGACTACTTGAACACAAGGAAACATCCACAAGCTACCGAGTCTTACCAAAACATAAATTTCTCAACATCAACTCT
ACAACAATTTTTTACAACTCCAAATAAATTTCTAATCACATTCTTCATCTAGCTGGGCTTCTTCTCATACAGCAAAAAGGACTTCC
TAGTGCACTCATGGCACATATATGGAAATAGAGTATAAAATGCCACTTTTATGAAGCGCCTTATGAAGTATCTTGTCAGGTAATCCA
AGCTATCATGTTTATGGAATTCATTTAAAAATAGCAGACTTTAGTTGCAAGATGAAGGCAAATACAAAAAATGAAAAATTAATGAAT
GAGAAACCACAGTCATGTCTGTACCTACAGTAAATCAATATAACAAGTTATAGAACATTCTACAATAGAAAGTGAAACCCAAAAGTA
ACAATATGTCCTACAGTTAATTTTAATGCTGAAGTAATAAGTTATTGCTACTCGAGACTCAAATGACATGTAACAAATAAACCGAAA
GTCAGGCATTATCATTTTGCAATACCAGGATAATGAATATTTCAGGCAAAACAGGTAACTCGTATCAACCAACATATATCAAGTAAT
TTAGGTTAAAATAACAGAAGTTGTACAACATGCAAATGAAGATTGGCTTCTGATATGTAGCCATTTATATTAATAGTATTCATATAA
TTTTGCATATAGATAAATAAGATATTAGTATTTTCGGCAAATAAAACCTAAGACATGAGCACAAGGAATTTGCAACCTATCAATATA
ACGCATAACAGCGAAGAAAACAACCATTAAGTACGCAAAGAAACAGGAAGGAAAACTTACTTCTCAAGAGTAATGACTGCAAGATGC
CCCCACAAATATCCTTGGCAATTATACACCAAAAAACATACTTCATGCCGAGGAATTTGCATGGACTCCCTTTCACTCTGATCCCCA
GATGCCTCCTTTTCCCAGTCATCATCTCTCTCCATCTCAACCTCCATAGAGTGGCTGTGACCTAGATCTTCCTTTTATCCCAGTCAT
CATCTCTCTCCATCTCCAGCTCCCTGTGCCTCTATAGTGATCCGCATATCTGTCTCTATCATCCCAATATCTTCCCTCTCCCTCTCC
CAATGACCATGACTCCCTCCCCTATCCCTTCCCATCTCCACATCATCCTGAAGCCTCCTCTCCCTATCATCCCTATGCCTCCTCCCT
CACCTCTCTTGCCCACCTCCTGCATCCTTCTGCCTCCCATGCCTTCTTTCAGGTCCACCCACCCCTTTTGCCTGTCAGGTTCCGGGC
CCCGCTCCCCTACCCCTCTCCTTCCCATGGATGACATCCTCTCCATACCGATGATCTGCACCTGCACCTCCACCATAGTCAAAGGCC
TCACCCAGCATTGGACCCGGGTGCATCACCCGAGTTCGGGTGTTTCCCCATTATCCCTCCGCCTCCGNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNTAATTGGCATAAAATCGGATTAGATTAGCATAAACCTTAT
TCACCCCCCTCTAGGCTTTTTTCCTAGCGGCCTTAGGGTCTAACAGTGGGTCCCACCGACCCCCTCCTCTCTTGCGTGATGCATCAC
GCGCGAGACAAACAGCGTTTTTGTTCTGGAGAACTGGAAAGAATTCGATTCAAGAGTAGGGTTTGTTTAATTATTTTCTTCAAGAGG
TGTGGCCCACCTTTGGGCTCTTGTAATTGATCTGGGCCTTCAATTTTTGGGCCCCATTTATTATACTTTCGACCAAGTTTGAGCTG
GGCAAAGAGTTGTCGGGTGGGGAGAGGTTAATACCGGAGGATTGAGGAGGAATGATGATTGATTAGGGATTTTTTTTTTTTCATT
TTTATTTTCTTTTCGGATCTCGAGTGATGAGGGATTTAAAACAAATAAATTTTCTTTAGCTTAGTTATTATAAACAATTTTCAATT
ATATATAACATTGTATTGTTGACATAATATCACAAGATAATTCTAGGGTTTTCAAAATAAATCAAACAACAATAAACCCTAGAAAAA
TAATCTAACACACATGATTAATTCAAAGAGGAAAATAACAATAGATGCAGGTTACTTAAATATATGCCTCTAGGCGTCAAAAAATG
CTAATAGATATCCCAAACATAGAGAAGATTACTCAAAGGGATCTCATATTGAAAATCAAGGCAGGAATGAACTGTCTCGACAGCGAG
ACAGGCTTTGCTGTCTCGCCAGCGAGACAGGCTTTGCTGTCTCGCCAGCGAGACAGTAAATAACGGAGTTTGAAACGTGGAAGAACA
GTTACAGCGAGAAACTGCCATTTTCCGAGACAGCATTTACTGTCTCGCTGAGCGAGACAGCAAATTTACTGTCTCGCGGGTCGAGAC
AGCAAACGCTGTCTCGCCCAGCGAGACAGTAAACACTGTCTCGCCGTACTGACTTCTTCGATTGTTAAGTTTTTGCAGTTACAGACC
CTTGAGGCTATAAATACCCCCCTAGGGTCACTTCTGACGAGGATCGAGCATTTGTTAGAGCATTCCAGAGCAGAGAGAGCAGAGATT
TGGGTTCTTTTCTTGCAACGCCTTGAAATTAAGCTTTGACTTGATTTTAAGAAGAACGACTATCTTACTTCGATAAGATATCGTTTC
AATTTCTACTTCGATAACGAAGTTAGAATCATAAGCCCCCTCTTCACGATCTGTGAATCGGCGGTCCACGAACCAAAGCGTTCCCGG
CACAGGCAAAGTCCCACGAAAACAAAGATCGATAGACGATTTTTGTGTTTGTTTCTCAAAAGTTGTAATTTTCGCTTTGTTGTGTAG
AAAAAGTCTTATAAAAAGATTATTCTTTCGAATTTGTTGTAATCGAACAAAGTTATAATGAATTCCACAGCAGCGACTTTTGAACCA
AACAAGCTGGCGACCACAGTGGGAGCCAGCGGCCTCGCTGCCGAGGCCGCGGTGTCGCAACCGATCAAGATCATCGTTAATGAAGAG
ATCGAATATGAGTTCGATCAGGCAAAATTTGAGGAGTACTTGTCGTCCTCATCCGCGAAATCTTCCTCGTCTCGCAAATATAGGAAG
ATTTCGAAAACTTTCAAGTCTGCAGTGTCAATGAAGACCGCGGGTGAAAGTTCTTGCCCGGATGTTGCTAAAGAATCTACTTGCAAC
ATATCTGCTCCGAACGACTCCACACCCATTCAGGAGTCGATGATGAATAGCTCGCCGGTGCTGACGAAGAGAGCTCGTCAGAGACAG
CGCCAGCGCCGTGCTCGACAATTGGCTAAAGCCATGCAACAAACCGACGGGGTCCATTACTATGTGGACCTAGAGTCGAGGAGACAG
AAAATGATTCAGTTGCCTCAACGGCAAGATAATCATATCTCTGCACAACTTACGACGGAGGAGTGGACTCTCGTCAAAAGGGCCCGT
TCAACCCTTAAGGAACGGATACAAAGGCGTAAAGCGAAGGCCGGCCATGCTCGTGCTCTTCGTCAACAAGCCCAAGGAACCAAAAAG
GAGACGGTGTCTGAAAAGCAACCGAAGAATCGTAGAGTCTGGCTGCCAAAGAAGCCGCAAGCATCTGTTCCGGGCCCGTCTACTGCA
ACACCAGTAGAACCCTGGGTTAGCCCAGATTTGTCCAAGTTCAAGATAACAATGGCAGATCGCCTTGGTCCTTCAGTTGATCGAGGC

Fig. 13DC

AAAGCCCCAGTCAAGGAACAACCATGTCCGGCAAATAAACCATTAATGGTTTCATATGCAGGGGGTCGTAAACACCCCTCCTGTCAGA
ACTGCACAAGTCCAAAACGAGAGAATACCAGTTCACTCTCGTTTAGGACCTCTGAAAACTCCACACCAGCAAGGGGGTGGATTCAAA
AATTCAACTTTGGATCGTTCAGAGGCGACGACCAGTCGTCCTGTGCATGTTAACAAAGTTCAGAAACAAAAGATAGGTTGCTCAAGT
CATAATAACGACGAGCTGTACTATCAGAAAAACAATTCAAGAAAAAGGATTGTTCGAGAAAATGAGTCTCATTGCCCTTGCGAGAGA
CTCATTAAAGCAGTGTTGACAGAATGTGGATGCTCTAAGAATAATTCAACAAGAGTCTCCGTATTTCAAAGATTGTCCAATGAAGCG
TCAAGACCCAAAATGAGACGTTTCAACAAGAAGAAACCTGCAATCCAACAAGATGAGTTCCCTGAGGTCACTATCAACATGACCAAT
AAAGGAAAGCAAAAGTCAGTCAATCCTGACCCTGATTTCTCTCCAGGAGGGAGAGTTGAGCCGGGTCTTTCTCAAAGGATGTTGCGA
TTGCAAAGAAGAGCCAACATACGACGAGACTACAAGAGAATGCACGAGGGACTATCTTCAGATGAAGAAATGTTAGATACTTGTTCC
GCCATTACGTCGGACGATACCGCGTCCAGTGTTGGGCAAGTCAGAGAATCATTTGCAGTCACACCGGATCAACTGGCTCATATCCTG
CAGGAGGCGTTGGCTAAACAACGCGAAGAAATTAGAGCTGAGTTCAAAACCGAAATGGAGTTGACTATGCAGCAGATGCGAGACTTG
CAGGTTCAGCAACACCAACCGGAGTTAAGCCAGAAAGCAGAATCCAGCCGGCCTAATGAAGAGGATGAGACTATCTTTGATGATCCT
CCTCCAGATAAAGACAACTCCGGAAGTGGTCCGACCAAGTCATCCACTCAACCTCCGCAAATCTACTTGAAGAAAAGCGAGGAAGAG
GACAAGAAGATGCACGATCTCGAGAGCAAAGTCAACGCTCTGATGACGGCTCAGGAAGTGAAGAAAACGGGCATTCCATACCCGTAC
CCGAGGGAGTGGACCCGATTCCTTATCCCCAGAAATTTAATTTCATTAACTTTGCTCCTTTTGATGGCAGGGGTTCACCAACTCAG
CACTTGATCTATTTCAAGTCGCATCTCGGCGCAATATCTGGGAACCAAGCCCTGATGGTCCGGTCATTCGTAGGAACCCTTCGTGGC
CCTGCCTTCGATTGGTACCGACGCCTTAAGCCCGGGAGTATTACTAGCTGGAGAATATGGAAGAACTATTCCTCACCAATTTCTTC
GACGATGACACAGAGGTTTCAATTGGCACGTTGTTGGATAAAAAGCAGAAGGATGGGGAATCGGTTGACGTCTTTGTCAAACGATTC
CGGGACAAAGCGGTGAACTGCAGAGATCCACTCACAGAAGAGTTCATCCTACAGACATGTCACAACAACTTGTCATTGGATGTGTTA
GAGGTGATGGGGGTTGTGCCCTCTAAAACTTGGAAAGAATTGAAGGTGAGAGGTGAACAGGCTGAACGCTTTCTCAAGAGGAAGAAC
TTGGAGGAGGTCTCCCACCAACTAATAATCAAAAGCAGAACTTTAATCCTCGAGGCAGAGGAAGAGGGTCTGCGGCAGCTGTTGAT
GCTCATCAAACATCACAACAGCCGCAACAACAACCGCAACAGTCATCTTTCCAATTAGCACCGAATCAAAATCAACAACCTCCGAGG
CAACCTAAGACTTCAGAGCCCAGATTCCCGAAGGAGTATTCTTTCAAGGATGATGAAGTACCAGTTATCTTCAAATATCTCCACCGG
TCACAAACCAAGAAGAAGCAATGAAGATTAATGACCCGAAGTATTGTGCCTATCACAGGAGGGTCCACCATCCGACTAAGACGTGTT
ATGTCTTAAAAGACAAAATACAAACCTTAATCGATGTTGGCATCGTAACACCGAAGCCGAAGGAGAAGAAAGTAGGTGCGAATGCGG
TGTCTATCAGCTTCGGGTCAGTTCCTTTGTCCTGGTTTCAAGTCGGTGCCTATCACAGGAGGGTCCACCATCCGACTAAGACGTGTT
ATGTCTTAAAAGACAAAATACAAACCTTAATCGATGTTGGCATCGTAACACCGAAGCCGAAGGAGAAGAAAGTAGGTGCGAATGCGG
TGTCTATCAGCTTCGGGTCAGTTCCTTTGTCCTGGTTTCAAGTCGAGCTAGTGTCTAAGGTCAAGGTGCAAACCATCAACGATGACC
CTTACGGACAGCGCCAAAAGGGGCTTATATCTCACACAACCCCCAACGGCGAAATCCTTTGGGTTCATCCGGATCTGCTCAAAGATG
AACAGTGGACAACATCCACATCAAAGAAGAAATCAAAGGCAAGGAAAAGAGAAATCCTGGAGAGGTTCAAATTCCGAAGCAGTCT
CGTTTTAGTCGACCGATTGGACGAGACAAACCGGAAAGCTCGAACGCACCATATCGTTTGACGTTATGGCTCAGCTGGCTAATATC
CCAGCAAGAATCACATTGTACGAGTTGCTGCGCCTCTCAAAAGAAACCAGAGAAGCTTTACAAGAAGCTTTGGCTGATTCTGAAGTA
TTCTTAACTCAGGTCAAGCCAGCTCCTGAAGAGCCAGAATCGTCAGTGCAGCATTGCAATCTGGCAGCCACCAAATTTCCTTGCATT
GCTTTCACAAAAGAAGACATGCAAGTCAGGAATTCAAAGCATGATAGACCGTTATATTTTACTGGATATATCGGTTCGAGCATGGTT
AACCGGATCCAAGTCGATCCGGGTTCCGCTGTTAGTATCATGCCACTTCGTTTGATGTACCACCTCGGAATTCCCGCCAGCAAGTTA
GCCTCCACTGGAACGGTTATCTATGGTTTCAACACAAGCGGGTCACGACCGTTGGGAAAAATCCGGGTGAAGTGTCAACTCGGAGAT
CTGAAGTCTGAAGTCACCTGCTATGTGATCGATGCGGAGACTTCTTATAATTTACTGTTGGGTCGTCCATGGATCCACGGTAATCTT
ATAGTTCCCTCCACCCTCCATCAGTGTTTGAAGTATGTCGACACTAATGAGGAGGTCAAGACGGTGGTCGCGGATAAGCAACCATTC
AAGGGGTTAGAAAATTACTTTACTGACTCCCTTCTTTATGGTGCTGAGTCCGATACTGAACCATCGGCCCATGGCACGGACAGCGGA
GAAGAAGCTGATACCGAAGCCGGGTTCGATTATAGTGAAGGTCTTGTACTAAATGACATTGAACCTCTTGTAATCGATCTTGACGGT
GATGAATCGTCGGACGAAAGTTGTAACTGGCAGCTTGCCGATGAAATAATAAATCATGATTTAGAGTACTCGCATTGTCTTGATGAT
GTAATGCAGAAATTATACGCCGACCCTAGTCTACATATGCCACTTCGTTCGTCCTGTACGAAGATGAAACACCTCCAAGATTCAAGC
GGAACAACTGTGATCTTACCCGCAAAGACAGGGGGTGAAAAAGAGATAGTTTTTGGAAAAGGAGAATCATCCCCTACTCCAGATCAT
TTCTTGGACAGTAATTCGGACAGAAAAAAACCCGGGCGACATTTCTCTCGGTACAGTTCGCAAGCGAATGATTATATGGCGAACCGA
GGTTATGACCTCTCACTCGGTGAAGGTCTTTATTTTGGTCAAGGCATATTCGGATAGAAAAAAACCCGGGCGACATTTCTCTCGGTA
CAGTTCGCAAGCGAATGATTATATGGCGAACCGAGGTTATGACCTCTCACTCGGTGAAGGTCTTTATTTTGGTCAAGGTATTAGGGT
TCCACCCCGTCCTGCCTATGTACCAAAAGGAAAACCAGATAATTATTACAGTCATAATAGGGGTCTGGGTTATGCTTCATCATCCGA
TGACGATTATGGCCAACAGATTATTAAATGGCCAACAGATCATTAACCAATTAGTAGACAGGAGTGGACATTCATCCGACACCTCGA
ATTGGGATTCTGATGTGAGCATTGGAGAAAAGTTCAAAAGTCTCATGTCAAATATGGCAACAGTCGATCCTTCTACAACAGAAGAAG
ACGATCAGTTGCCCACTTGGGAAGATCCTTGGACACATTACATGAATATCCAATACGGTGATCGATTTGAGCAAAGAGAACCTCCTA
CTGAGGACAAAGTAGATCAAGTTAATATGGGTGACGAAAGTAATCCGAAACCCATATTTATTAGTGGTGATCTTCCACCGAACGAGA
AAGAGGAACTAATCGCCCTCGTTCGAGAGTATATCGACGTTTTCGCTTGGAATTACGAAGATATGCCGGGACTCGACCCAGATGTAG
CAATGCATAGCCTTAACATTAAACCGGATGCCAAACCTGTCAAACAACAACAAAGACGGTTTCGTCCGCAGATTATGGAAGCGATAG
AAGCTGAAGTTAAGAAACTGATTAATTTGGGTTTTGTCAGAGAAGAACAACATCCTGAATGGTTGGCCAATATTGTTCCAGTCCTCA
AATAGAACGGAAAAATCAGAATCTGCATTGACTTCAGATATCTTAATACGGCCTGTCCCAAAGATGACTTTCCTCTACCGATTACGG
ACGTCATCATTGATAACACATGCGGGTTCCAAGATTCAGGCGGAACAACTGTGATCTTACCCGCAAAGACAGGGGGTGAAAAAGAGA
TAGTCTTTGAAAAAGGAGAATCATCCCCTACTCCAGATCATTTCTTGGACAGTAATTCGGACGAAGAAAAAAACCCGGGCGACATTT
CTCTCGGTACAGTTCGCAAGCGAATGATTATATGGCGAACCGAGGTTATGAGCATCCAGACGATGAAAAACATACAGCATTCAGAAC
GCCCCTTGGTGTCTTCTGTTATACTGTTATGCCTTTCGGTTTGAAGAATGCCGGTGCAACATACCAACGGGCAATGACAAAGATCTT
TCAAAAGCACCTTCGAAAGACTATCGAATGTTACGTTGATGACCTGGTCGTTAAAAGTCGCGATAAAAACGACCACATCAATGATTT
GAAGATGATGTTCGAGCTTATGAGAATTCATCAACTAAAAATGAACCCGACTAAATCCTTCCTTGGAATGTCCAGCGGTAAATTCCT

Fig. 13DD

CGGGTTCGTCGTCACCACAAAAGGTATTCATATTGATCCTGATAAGGTGAAGGCAATACATGAGTTACAACCCCCGAGAAAATCTTAA
AGAACTCAGGGGGTTGCAAGGTCGATTGGCATACATCCGTCGGTTTATATCAAATCTGTCTGGAAAAATGTCAACCCGTTCTCTAAACT
CGCGAAGAGAAAGGTGTGTCGTTCGTTTGGGATGAAGCATGCCAAAAGGCATTCGAAGATATTAAGAAAATATCTGGCGAATCCACCTAT
TCTCGTTGCACCGAAATCGGGCAGACCGTTTTTTATTTATGTCAAAGCGACGAGCCATTCGTTAAGTGCATTACTTGCACAAGACGA
CGATAACGGTCACGAGCAACCTGTGTATTATCTGAGTCGTACATTGGTAGGACCTGAGTCTCGTTATCCGATGATTGAGAAGGAATG
TTTCGCCTTGGTATTCGCGATTCAGAAAATACGACATTATTTAGTTGGACAGACAATTTATGTCATTTCCAACATAAATCCCGTCCG
AGTGTTCATGACCCAACCGGCTTCCATGAATTTACGTTTGGCCAGATGGGCTTTACTCCTATCGCAATATGACTTGTACTTCAAGCA
ACAGAAATCTGTTAAAGGATGAGCTATTTGCGATCTTCTGGCGGAAAACCCTACGAAGGATGTAGTCGAATTGTACGACGATCTGCC
AGATGAAACTCACGAAGTTAATACCACCTCACATCAACAAGTGTGGCAATTGTACTTCGATGGGGCTTCCCGATCAACCAACGTGGC
AAGTGCACCTGGATGTTCTAAAATCTCCTCAGGAGTGGGGTCGTTTTAGTTTCCCCGGAAAAGCACGTTTTGCCTAGAGCATATTC
ACTGACCGAACCATGCTCTAATAACGTGGCTGAATACAATGCATTAATAATCGGACTTAATTTCGCCAAAGAGCTGGGGGTCGAATA
CCTTGAAGCTTTTGGAGATTCTCAACTGGTGGTTAATCAAATACGAGGAGAGTATGAAGTCAGAAATCGAGACCTGATTCCATACCA
CCAGGTGGCCATCGAAATAGCAAGCTCGTTTGAAGAATTTTTCATCGAGTACGTTCCGCGTCTCCAAAATACATACGCAACAGAGCA
ATTGATTACAGTGAGGACTCACCAGCTTATTGTTCCAATCTACGATTCGAATGCTAAAGAAGTATACTCAACTGGAGTTGAACTCGA
ACTTCGAGATTAGCGCTTTCCCATTATCGACTACGTCTTACATGGTATATTACCTGAAGATGTAAGAGAAAACGGAATCCGATTCGCG
AAGAGCACCGAGATTTTACTACAATGCCACAACCCAAACGTTGTATCGACGATCTATGATGGTCTTTTACTCCGTTGTTTATCCAG
CAAAGAAGCGGAACAAGCACTTAAAGAGGCGCATAATGGGATATGCGGTGCACATCAGCCCGGTCCTAAACTCTGTGATCGACTTAG
GAGAATAGGGTATTACTGGCCAACTATGGTAAAAGACGCAGTTGAATGCGCCCGACGATGTGAGGTATGTCAATTACATGCAAATTA
TAGGCACATACCCCCTGAGTATCTTCATCCTTCGGCGACATCGTGGCCGTTCGAAACATGGGGAATGGACATTGTAGGTCCTATTTT
TCCGCCTTCGGTTAAAGGAGACTATTTTATCCTAGCAATCACCGATTACTTCTCGAAATGGGCAGAAGCAGTTCCACTCCGAGAGGT
GAAGACGAGTGATGTGATCAAATTTATCAAACACCATATCATATATCGATACGGTGTTCCGAGCCGAATAGTGCACGACAACGGTCC
TCAGTTCGTGAGCAACGCGTTTATCAAGTTCTGCGGTAAATTCGGGATTAAGGACGTTTCGTCGACTGCTTATAATCCTACGGCTAA
CGGATTGGCCGAAGCTTTTAACAAGACAATCATCAAAATTCTGGCAAAATTGGTGAAAACCAATAAACCAGATTGGGACGATAAACT
TGGCGAAGCTCTCTGGGCTTATCGTACGACCGTCCGTACGCCTACTGGAGCCACCCCGTATGCTTTAACATATGGATGTGAAGCCGT
CCTCCCCTTGGAAATACAGATTCCTTCCCTCCGTATCGCTCTCGTAACAGGAATGACGACGGAAGAACATCATCAGAAACGTCTTGA
GGAATTAGAGATGTTAGATGAGAAACGCTTGGAAGCTCAACAACAAATCGAGTTTTATCAAGCTAGAATTTCTCGGGCTTTCGATAA
AAAGGTCCGACGACGAAGCTTTAAAGAAGGAGATCTAGTGCTCGCTGTTCGAAGGCCTATGATCCTCAACTTCAAAAAGAAAGGCAA
ATTTGAACCTAAATGAGAAGGACCATTCGTGATAGAGACAGTCTATTCAAACGGTGCTTATCGTCTGATTACTCAGGATGGCAACAA
ATTAATGATGCCAATAAATGGAAGTTCCTGAAAAAGTATTATCCATAATACGTTCAGGATAACCTATGTAAAACGGGAAGTTCCTA
AAGAATCCTGTATAGGATATTTCAGGATAACCCGATATCAGTTGATTATTCTAAATAAAGACTGATCATGTGAATAATCTATTCTTA
ATTGTTATAAAAAATAATTAAGATCCTCATATTACTTTTGTTGAGATGAGATTTAATGACAGTTAATCTTCCCTCAGCAAAATCTTG
TAATGTAATCATGGAAGAGGGGATTCAATAATTTGTAATCTCACACCATGAAACCCTCACTGATCGGATCAACCAATAGTCATCAGT
CTGTATCAGTCAACAAATTATTTTGTGTCAAATTCTTATGTTTGAAATCAAAATTTCCCACCGAGTAGTTTGTGCAAATCAACAAAC
TCATTGTTATTTACACCCTACTCCTATTCCTCACTTGGTCAAACCTTTAAATAGTTAGGACCAAAGCCAAAATCCCTTCTCGATTCA
TTCCATGAACGAGAGGTCCACAAATTGAGCAATCAAACTTTCCTACAATTAGGATCATCTCAAAACCCCCACTTGGTCAAACCTTAC
TACAGTTAGGACCACAGCCAAAATCTCTTTTCGATTCATTTTTTGCGAACGAAGGTCCACTTTTGAATTGAGTAATCAAACCTTAT
GACAGTTAGGATTATTCAAACCAATCCAGATTCTCTAAGTGGATATCCCACTTTGAGTTTCTTTACTCCAGGAGATAGAATATAAAA
TTCTTCCTCTCCGATTCTGGGTTCATCTCTACCAACAAACAAGAGATCAGGAGATAGAATATAAAATTCTTCTTCTCCGATTCTGGG
TTTATCTCTACCAACAAACAAGAGATTGAGAAATGGAATATACAATTCTTTTTCTCTCCAATTCTGGGTTCATTTTCCTGTATAGGA
AATATAACCTACTCTCATTCCAAAATCCATGTCGTTCACACATGGGGGAAATTATCTCTATCCCTTATTAGAGATAATCCTGCATCT
AACACATGTAGCCTACATATTCAATATGATAGTTCAAAGTCTAAAAGAGTTTAGGGGAAGTTATCTTTATCCCTTATTAGAGATAA
GCCTACATCTAACACATGTAGCCTACATATTCAACATTGTAGTTCAAAGTCTAAAAGAGTTTAATTCTTTTAGCCCAACGTTATATG
TGAAACGGACCTAGATAATTCAAATACTAGCCCGATTCAAACGGTAATCGGTAAAGGCATATCAAATCCGTTGATGGCTGAGGATTT
GCCAAAAATCCTATAAGTATTATGGTTATTTATTCTAAACAAGAATGAGTAATCATAATAAAAATCTCAGTGACCAAAAGATTCAA
TATATTGACCAAAAGTGTTTAAACAAAACTACAAAAAATATATGTTCTCCAATTACAAAAGTTTATATTGACTAATCTGATTTTCAA
GTTTTGAAAGCTCTAATGCATAAGCCTGTTCAAGCTCAGCCGCCAATTTAATTTTGAAGGCTTCTTCATCAACACTGTGAAGCGCGG
CGACCTCTTGTTCCTTTTCAGCAATCATTTGGTCTTGAAGGTTCAGTTGCTGTAATAAGTTGCCTTCAGTGTGAATTTCCCGCTTCA
ACTCGGACTTCAAGACATCATGAGCATCCTTGGCCATTGCAAGTTCCTCCTCTAAGCGAGCTATTTCTGCTCGACTCGATTCTAAAT
CCCGACGTAGGTTAACCTGGGCTTGTATTCTCTTGCCAACATTCATCCTAAGTTGATCGCTGTGGGCTCTTAGCTGTTGGAGCTCGA
GATTAGCTGATGTTTGGGAATCACGCAACGCTTGTAGCTTGGAGTCCATGCGAGAGGCAATGTAGGAAGGTACGCTTTCAGTGCGAA
GACCCTTCAGAAGTTCAACATGTTGCTTCAAGTCAACCATATAGGCGTTGATCGAATCGTTGATAATGATGAAGGAACTGCGAGAAA
GTCAAATAAGTCAGTACAGGATATATATATATATATGCATAGAAGACAACAAGCTAAAGCATACCAAGTTCGACGGAAGAACTTTCAGC
ATGACTTGGTTCGCCCAAGGATGGTAGTCTGGATTCCTGAACAGTCAAGATTGGTTCAGGAATGGTAGCTGTTGATGCACCCGCTAC
GTCAGGGACTTTTTCAACTAAAGCCTCAGAAGACGGCGGGTCCAAACTAAAAGACTCCTTAAGAGGAGATTCTACAAACAAAAGAAT
TACAATAAGCATAATGGAATGATAATCCGAACTTGAAACAAATTATGACTAAAACTTGCCAGCTCTGGGTACAACATCGGCTGAAGT
ACCAACTTCTTCAGTTGGTCTCGCTTTTGTTGCCACCGGACTGATCTGGGGGGTGACGGTAACTTCTATCATCATCAGATCCATAGG
AGTAGCAGGCTGGAATTCAGCAATAGATGATTGGAGATTAACTTCAGTTCCTACCCATGGCACGAGGTCGCGACCCTCCGGTTGTTC
AGACGTTTCAGTGATTATAGTAGTATCAGTTCCAGTAACTGGTCCTATAATTCGAACGCTTATATAATTAATCAAGTCAAAATATAT
ACGTATGTATATACGGAGTTTACAGAGCCAAAGTCTTACTCTCAGAAGGACCTGCTTCTGTTGAANNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNNNNNNN

Fig. 13DE

NNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNNNNNNNNNNN
NNNNNNCTGGGAGAGCCGGTTCCTTTCCTTTCCTTGATGATTCAGCAGCCTCTTTTCCTCGAGGCGACATCACAGCTTCACGTGTC
ACTTCTGTTGCTTGTCGTGGAGCTATCTCTTCCTCTGAGTCTGATATCCTCCTGCGTCGAGTGACAATATTGGCGGCTATCAACCAT
TTGCAAAAGAGGAAGGTCATCCGTAGGGGCGGCGTCTCTAAAGGAAGATCGAATTCGACATTTGTACAGCCGGCGATGCTCCAGAAC
CAAGCCCTCGCACCGTCGATAAGTCCACCTCGAGAGCTAAGATGGCGGTTTGGATTGCCAACATATATCTGATCATAGCCGAACTGA
CGGGCGAATCGACATAGGAGATAAGGTTCAATGTGACAAGTATCTCTTACTCTGAACAACAGATATCCAGGTCGAATGTTCATCAAC
CATCTGAAGCACCCGACATCCAAGATAGTGCGATTCTGCCTTCGGTCTTCAGCATCCAATAAGGTACTATTGTAGGTACCCGAGAAC
TGAGGGAAGCAGGGAAGAATTCCCAACACTTGTGAATTTTAAACTGCCTCGTTATGTCGGGTTCTCGATGCCTGATCCATTTGCAA
TTCTCGAGATTCTGTAACAGAGGGATGCTAGAATTTGCCGTCTCAAGAGCTTCCATTAAATCTGGTCGGTGAAGTACTAACTAGGTC
ATCAGATAAGTGTAGGGTAGCTCCAACTTCGGAACCAACAGACTGGCGGAGGGTTTCTTTTTCTCCTGAGTAAACACGGAGATTAAT
TGCCGTAATCCACTATGAATATCGGCCACCATAGCGGAAAGCAAAGATAATTTGCGACCTGTAACTAGCTGGACGGCCGGATACAAC
ACTTCCATTGGCATCGCATCTGAAGACTGGTGGGAACTCAGCTGGACGGCGGATACAATACTTCCATTGGCATCGCATCTGCCGA
CTGGTGGGAACCACGCACCTCTTTAGCCATAAAGCCAGAAAACCCGCTAGCAGAGCAGTAGGGCTAATTGGAACACCAGCTTGCCA
CAGATAAGAGCGGAATTAGTGCCATGCGAAAATCCGTCTTCTGAGCGCGAGGTATAAGATTGCGCATTTGTTTTCTTTAACAGATGA
TTGATTTCGCCCGAATTCAAAGGAGACAACCCGCATACATCTGCCGAATGGTCATCCAAATTCTTGAATAGATAATCGGCGAATTGT
TTCAAGCTGACCTGAGGAGATTTCTTTCTAGCTTTGGGCTCCATCTCGGCCATGGCTATATGATAATGGCAGGTCAATTCCCATAAA
GTATCATGAGTCACAGTTGAGCTATCTTTCATCTTGTTCAGCTGATTGCTAGTTGGAAAGAACTCTTGATAGGGAACATCGCCCATA
GGCAAACCAGACACCATGCAGTGGTAGTCCGAGTTCCCCGTTCTTGGTAAAGAATGTATTAGTGTCCGGGTTATAAATCTCGAACAA
ACAGAGAAAATGACCTACACTACTCTGCAGGCCATGCATGCTGGCACGGATCGGGACATCCAACCCTAATTCTGCCAACTCTCGCCC
AAAACGGTTTAACACATATCGGGTCATCCTGGTCCACCACCATTTGTCCCCAGAATAATGGACCCATCCATAGCATCTAAAAGTCTC
TCTGGGTAATTTCTTTCCTGCTGCCGCTAACCGATTCTTCACGGTGTTGGCTTGCACTATCTTCTCATTCTGAGGTATGTTGTCTTG
TCCTAAGACACCCGGATGAAGCCCCCGCACATGAGCTCTTTCACTGGAGCCTGGGTTGGCTTCCTTCCCAATAAAACCACAATGAAT
ACGCTCGTGATTTTCAGTCAACTTCCAGAACATCTCACGTCCAACTGATAGATTCCTGAACATTAATAGTGAGTGATCCCGGGGGAT
AAAAGGCAGATATAAGAATGAGGACCCATTCTGGTGCAACCATTGCGCAGGCTGGCAGAAAGCAATCTTCGGATCTTTCACCGAATC
ACCAAACAAGAAATCCGGCTTCCTTATGCATTGATTCGAGTCTTGCTCCCGAGGTCAAGGTCGCATCCCTGATTAATCGTCGTAGAAC
ACGACAACTACCTCGCTGGATTAATTCCCTAGCATTTTCGCTGTAGCCAGATCTGAACTGGGGAGAGGATTCAATTAACGGGATCCC
CTCGTAATAAGAGTGGGTCACCCTACTCCGGCCAGTAACCACATCAGCAGTAAAGGTGGTAGAAGGAAATCGGACTGATAAAAGAAA
CATACACATAAATTGTGTAAGTGTAGTCCTAAAATTTTAGAGAAAACGGTATATCTTACTTCATAATATATAGTGCCATCTCACAAC
AGGCGTGATGATTTTCCATCTACCACATGTATAAAGGAGATATGCGTTACTATGCATAGACATTATAACGGCATACCAAAACCTTTC
AATACACGTGGGATGATATGAAATCGCCCCTGTGTATTCTGAAGTGTGTTTTGTCAAAGCAAAACAGACACTTTTAAGCGTCGATCC
CCTCAAAGGAGGATACTGGCTCTTCTCGAGGGTATCTCAAAGGATACAAACGAGGATCTGCAAACAAATACAGAGACATATATATGG
AACTGACGAAATATAGTATTTAAATTCGTGAAAAGGTGAAAAAAATATACCTCCACGAGAGATCGCAGCAGGGGCAGCCTCCTCAGG
GCTCTGAACAGGTGGATGGCTTCGGGTTCCTCGAGCTCTACGCGGCGACATGATGAGTATGTGATCTACATTGAAACCCAAGAGGAA
AGCTAAGATTTTTAACATGAAATCGACAAAAAATAGGGCAAATACAACCGAAACAATGCATGCACAGTCACAGTTGAAGAAAATCAA
AATTTTGGAGAAAAATGAGTGAACACACCTTTGAAATCCGAATGCAATCTTCACAAACAAGAGCACCACCCAAGTCGGCAACAAAGA
GGAAAAGAAGTAGAAGAAAACTGGTCGAAAATCGCCCAAGAAATCGCCTGAAAATCGTCAAAATCCGACGTGAAAAAGTCCTAAAAA
ACCCTAAGTTCGAGTTTTATACTCGCTGGCTCGCTCAGCCAGACAGAAAACTCTGTCTCGCTCAGCGAGATAGAAAACACTGTCTCG
CTGAGCGAGATAGAAAACACTGTCTCGCCGAGCGAGACAGAAAACACTGTCTCGCCGAGCGAGACAGAAAACATTGTCTCGCTGAAC
GAGACAATGAACCCTCTCTGTATCGCATTGCGATGCAGATGAATACTCCAATGGGTACACGAGTCTAAACTGTATTCCCACCCTCAA
CAGGAAGTTTCTGGAGAATATTAATTTGAATATTCTTAAGGATAACCTGATGAGCTCTCAATGGATATATCAATTCAGTGATAAAAA
AAACTGAACCCGCAAGAACAAGTACCAACTTCAATTCAAGATTTCGACAACGGTCAAGCGATAAACGCGACGCCGGGAAAA

>lcl|scaffold10515
CAACGACATGTCTGAAACCTGGGTTTCTCGATTGATATCGGATATAGAGTGGCTCAATAGCAGAAATGCCCTGATGGCAGACGCCTG
GAGTCGTCATTCCATCTACACCGTCCCGGACACATTCAGAAGGATTAGCCCACAGATCCATAAGCCTTCAACGTGCAGCATCGGACC
TCGGCACTATGGAGATCCGAATCTCCATCGTATGGAATGTCATAAACACAGGGCCTTACAGAACTTCCTCGTCCGATGTCGAGTGTC
GATCCATGACATCATAGAAGCCCTGAACAAGAACCTGCACGACTTCAGAGCCTGCTATCAAGATCTTGATACATTTTGCATGAAAAA
TGATGATGAGTTCCTAAGAATCATGCTTTATGATGGAGCATTCATGATCGAAATAATGTTAGCGACCTTTGAAACATATGTGTGCGC
ACCTTCTAGTTATCACGCAAAGGACCCAGTATTCAAAAAACCATACTTGGTTGAAGATCTTCGTGTAGATATGCTCAGGTTGGATAA
TCAAATTCCAATGAAGGTCCTGGAGATATTGTCTGAATTCTGCAAAAACAAGGTGATGAATGTTAACGAAATCTAAATCTTCATACC

Fig. 13DF

TTTAAATATCCCTGTTGTAACTCCAAACTTGCACAAAATTTTCATACCTCGTAATGTAAGATTAACCTAACAGTCAACATTGTATAA
AATGATACATTATGCAATGAGGATACTCCCACAAAATTTGCTATTCATTGATCAAATCATTCCCATGAGAATTTTTTGCAAATAAAT
GAGTAATGTGCATGCTCAAGATAGCAGTCACCATATTGAAATCCAGCAGAAGACACTATTTGCATACGCATCATATAAGCTCTATTG
AACTAAGACCTGGATAAATAACTTCTGGATAGATAAACTTTTTTCAAATCCTGCAGAAGACACTATTTGCTGTAAGTGTTGAACTTT
GTGTATGGATCCCTTTATAAAGCAATCACAATTTATGCTGTTGCTTAAAGTAAATAACTTTTTTCTGTCTTCCAGATTCAAAGCATT
CACCAGCTAATCAGACATTTCTTCTTCCACAAATATGAAGAGGGAAGATATGATATTAGCCAAACCTCTAGGATATTTCACCTAACG
GAGATAACAGGGCATCACCTGCTGGATGTGTACAAGAAAACTCTTATACAGAATGGAGGTTATCATCACACCAACAGTCGCCAACCA
CTATCGGCAGTTGAACTACAGGAGGCGGGCGTAATTTTCCAGTGCAGTGAAACGCCATCATTAACAGATATAAGCTTCGCCAAAGCT
GTCCTTTGCCTACCTGCAGTCGACGTTGACAAAGCATTTGAAGTTGTTATGCAGAATCTCATTGCCTATGAGCAAGCACATGGCGAA
GGTCAAGAGGTAACATCCTATGTGTTTTTTATGGA

>DH00/086 GDS gene region
ATGTCTGAAGCCTGGGTTTCTCGATTGACATCGGATATAGGGTGGCTCAATAGCACAAATGCCCTGATGGCGGAGGCCTGGAGTCGT
CATTCAATCTACGACGTACCAGACACATTCAAAAGGATTAGCCCACAGATCCATAAGCCATCAACGTGCAGCATTGGACCACGGTAC
AATGGAGATCTGAATCTCCTTCGTATGGAACGTCATAAACACAGGGCGCTACTGAACTTCCTCATCCGATGTCAAGTGTCGATCCAT
GACATCATACGAGCCCTGAGGAAGAACCTGCACGATTTCAGAGCCTGCTATCAAGATCTTGACACCTTTTGGATGAAGAATGATGAT
GAGTTCCTAAAAATCATGATTTACGATGGGGCTTTCATGATTGAAATCATGATAGCGACCGTTGAACCATATGAGCGCACACCTTCT
AGCTATCATGCCAAGGACCCAATATTCAAGAAGCCATACTTGGTCGAAGATCTTCGTGTAGATATGCTCAGGTTGGATAATCAAATT
CCAATGAAGGTCCTGGAGATATTGTCTAAATTCTGCAAGAACAAGGTAAGGAATGTTAATGAAATCTAAATCTTCATACCTTGAAAT
GTCCCAGCTGTAACTCCAGAAGAACTTGCACAAAATTTTCATACCTCGTAATGCAAGATTAACCTAACAGTCAACGTTGTATGAAAT
GATACATTATGCAAGGAGGATACTCGCACAAAATTTGCTATCCATTGAAGATATCATTCCCATGAGATTTTTTTGCAAATAAATGAG
TAATGTGCATGCTCAAGAAAGCAGTCACCATATTGAAATCATGCAGAAGACACTATTTGCATATACATCATATATGCTCTATTGAAC
TAAGACCTGGATAAATAACTTCTGGATAGATAAACTTTATTGAAATCCTGCAGAAGACACTATTTGCTGTTAAGTGTTGAACTTTGT
GTATGGATCCCTTTATAAAGCTATCGTAATTTATGCTGTTGCTTAAAGCAAATAACTTTTTTCTGTCTTCCAGATCCAAAGCATTCA
TCAGCTGATCAGACATTTCTTCTTCCGCAAATATGAAGAGGGAAGATATGATATTAGCCAAACCTCTACGATATTTCACCTACCCGA
GATAACAGGGCATCACCTACTGGATGTGTACAAAAAAACTCTTATACAGCATGGAGGTTATCATCACACCAGCAGTCGCCAACCACT
ATCGGCAGTTGAACTACAGGAGGCGGGCGTAATTTTCCAGTGCAGTGAAACGCTGTCATTGACAGATATATGCTTCACCAAAGGTGT
CCTTTGCCTACCTGCAGTCGACGTTGACGAAGCATTTGAAGTTGTTATGCGGAATCTCATTGCCTATGAGCAAGCACATGGCGAAGG
TCAAGAGGTAACATCCTATGTGTTTTTTATGGATGGCATTGTAAACAATGACAAAGATATTGCCTTGCTTCGAGAGAAGGGTATTAT
CAGGTCGGGGGTAAGCAGTGATAAGAGGATAGCCGATCTTTTTAATGGACTGACAAAAGGTATAGTTGCAAAAGTTGTCGACAATGT
TGATGTTGATGTAACCAAGGACATCAATGAGTATTGCAATAGAAGATGGAACAGGTGGCAAGCCAACTTTAAGCAGAGATACTTTGC
GAATCCATGGGTAACTTGCTCACTCATTGTAGGAGCTCTAGTATTAGGTCTCACCATCACTCAAACAATCTATGGCATCCTTTCTTA
TAATAAGTGTAGTTAATGTAACTCTCATACTCGAAAATGTATGGATGATTCCAGTCTTGATCCCAGTCTTTTGTCATGGCTGTGTGG
CTGTAAGCATTGTAATTTGAGACAATGACAAGGATGAATAGGCTAATATCAACTGAAAAAGCTTCATATTTTTTTTGGTTTTTGCTC
AAGATTGAATAAAAATGGCTTTAAAAAGGTAATGTGTAACAATGTCTCAGATTTTATTCTTTCCACACCCTGAACTCAACTTGGTTG
CTTCTGTGCCCAAGTCAAATATTAATAAAACCATGTGCCTTTCTTGCAAGATCTTGGATTTTGTTCGGGTGCCATTTAATAAGAGAA
GCTTGAAGGCATCCCTTTGCATTACCCAAATGGAATCTGGGAGCTATGTTTTAATTACATTTAAATAGTGGCTCTTTGAGGGTGTTT
GTCTTTCAAATGTTCAGTTCCATGTCTTACTTCCAGTTATAATTTTTTCTAGTGTAGTGATACTCTTAGTTTCTGCTCATGATTTAA
TGCATAGTATCTGGCAACCAATAAATGCAAATGCATTAGTGTCGATCACATAACAAGAAATGATTAGTTCTTCGAGCCAATTTAATT
TTCTCTGTTATTCCTTGATTTCCAAAACTTTGTTATTGTTTTGTCTTATCTGATCTCAGTCTTTCTTTGCAGGCCTTTCCCGGGATT
CATAAATGTTGATCTCAACGGTAGGGTTTCGTGCTGGGGTTTGAGTATCTGTGGAGCATTTAGTGTGAGAAAACTGTGCTTAATTTC
GCTTCTCCACTATGAGAGTGGAGGAGCACAACTAATGGTATCCAGTGTAAATTTAACTCTTTGTTTGTGGCTTGAGAACAACATGTT
CTTTATATAGCCTTTGACAATGTAATAGATAACATCAACTTCTTTGATACATACTAGCGATATTAGCATCCTATCTTTTTCTTCTTC
ATGTTAACAATCCTATAGCCTTTACACGGGTAATATATCCTTGTGATGTTTAATCCTAAGTTTTTCTCTGGTCAGTGAATATGAACA
GCAGCTATTATTTTATTGCTTGTTC
>9M GDS gene region
ATGTCTGAAGCCTGGGTTTCTCGATTGACATCGGATATAGGGTGGCTCAATAGCACAAATGCCCTGATGGCGGAGGCCTGGAGTCGT
CATTCAATCTACGACGTACCAGACACATTCAAAAGGATTAGCCCACAGATCCATAAGCCATCAACGTGCAGCATTGGACCACGGTAC
AATGGAGATCTGAATCTCCTTCGTATGGAACGTCATAAACACAGGGCGCTACTGAACTTCCTCATCCGATGTCAAGTGTCGATCCAT
GACATCATACGAGCCCTGAGGAAGAACCTGCACGATTTCAGAGCCTGCTATCAAGATCTTGACACCTTTTGGATGAAGAATGATGAT
GAGTTCCTAAAAATCATGATTTACGATGGGGCTTTCATGATTGAAATCATGATAGCGACCGTTGAACCATATGAGCGCACACCTTCT
AGCTATCATGCCAAGGACCCAATATTCAAGAAGCCATACTTGGTCGAAGATCTTCGTGTAGATATGCTCAGGTTGGATAATCAAATT
CCAATGAAGGTCCTGGAGATATTGTCTAAATTCTGCAAGAACAAGGTAAGGAATGTTAATGAAATCTAAATCTTCATACCTTGAAAT
GTCCCAGCTGTAACTCCAGAAGAACTTGCACAAAATTTTCATACCTCGTAATGCAAGATTAACCTAACAGTCAACGTTGTATGAAAT
GATACATTATGCAAGGAGGATACTCGCACAAAATTTGCTATCCATTGAAGATATCATTCCCATGAGATTTTTTTGCAAATAAATGAG
TAATGTGCATGCTCAAGAAAGCAGTCACCATATTGAAATCATGCAGAAGACACTATTTGCATATACATCATATATGCTCTATTGAAC
TAAGACCTGAATAAATAACTTCTGGATAGATAAACTTTATTGAAATCCTGCAGAAGACACTATTTGCTGTTAAGTGTTGAACTTTGT
GTATGGATCCCTTTATAAAGCTATCGTAATTTATGCTGTTGCTTAAAGCAAATAACTTTTTTCTGTCTTCCAGATCCAAAGCATTCA
TCAGCTGATCAGACATTTCTTCTTCCGCAAATATGAAGAGGGAAGATATGATATTAGCCAAACCTCTACGATATTTCACCTACCCGA
GATAACAGGGCATCACCTACTGGATGTGTACAAAAAAACTCTTATACAGCATGGAGGTTATCATCACACCAGTAGTCGCCAACCACT
ATCGGCAGTTGAACTACAGGAGGCGGGCGTAATTTTCCAGTGCAGTGAAACGCTGTCATTGACAGATATATGCTTCACCAAAGGTGT
CCTTTGCCTACCTGCAGTCGACGTTGACGAAGCATTTGAAGTTGTTATGCGGAATCTCATTGCCTATGAGCAAGCACATGGCGAAGG
TCAAGAGGTAACATCCTATGTGTTTTTTATGGATGGCATTGTAAACAATGACAAAGATATTGCCTTGCTTCGAGAGAAGGGTATTAT
CAGGTCGGGGGTAAGCAGTGATAAGAGGATAGCCGATCTTTTTAATGGACTGACAAAAGGTATAGTTGCAAAAGTTGTCGACAATGT
TGATGTTGATGTAACCAAGGACATCAATGAGTATTGCAATAGAAGATGGAACAGGTGGCAAGCCAACTTTAAGCAGAGATACTTTGC
GAATCCATGGGTAACTTGCTCACTCATTGTAGGAGCTCTAGTATTAGGTCTCACCATCACTCAAACAATCTATGGCATCCTTTCTTA

Fig. 13DG

TAATAAGTGTAGTTAATGTAACTCTCATACTCGAAAATGTATGGATGATTCCAGTCTTGATCCCAGTCTTTTGTCATGGCTGTGTGG
CTGTAAGCATTGTAATTTGAGACAATGACAAGGATGAATAGGCTAATATCAACTGAAAAAGCTTCATATTTTTTTTGGTTTTTGCTC
AAGATTGAATAAAAATGGCTT
>98M GDS gene region
ATGTCTGAAGCCTGGGTTTCTCGATTGACATCGGATATAGGGTGGCTCAATAGCACAAATGCCCTGATGGCGGAGGCCTGGAGTCGT
CATTCAATCTACGACGTACCAGACACATTCAAAAGGATTAGCCCACAGATCCATAAGCCATCAACGTGCAGCATTGGACCACGGTAC
AATGGAGATCTGAATCTCCTTCGTATGGAACGTCATAAACACAGGGCGCTACTGAACTTCCTCATCCGATGTCAAGTGTCGATCCAT
GACATCATACGAGCCCTGAGGAAGAACCTGCACGATTTCAGAGCCTGCTATCAAGATCTTGACACCTTTTGGATGAAGAATGATGAT
GAGTTCCTAAAAATCATGATTTACGATGGGGCTTTCATGATTGAAATCATGATAGCGACCGTTGAACCATATGAGCGCACACCTTCT
AGCTATCATGCCAAGGACCCAATATTCAAGAAGCCATACTTGGTCGAAGATCTTCGTGTAGATATGCTCAGGTTGGATAATCAAATT
CCAATGAAGGTCCTGGAGATATTGTCTAAATTCTGCAAGAACAAGGTAAGGAATGTTAATGAAATCTAAATCTTCATACCTTGAAAT
GTCCCAGCTGTAACTCCAGAAGAACTTGCACAAAATTTTCATACCTCGTAATGCAAGATTAACCTAACAGTCAACGTTGTATGAAAT
GATACATTATGCAAGGAGGATACTCGCACAAAATTTGCTATCCATTGAAGATATCATTCCCATGAGATTTTTTTGCAAATAAATGAG
TAATGTGCATGCTCAAGAAAGCAGTCACCATATTGAAATCATGCAGAAGACACTATTTGCATATACATCATATATGCTCTATTGAAC
TAAGACCTGGATAAATAACTTCTGGATAGATAAACTTTATTGAAATCCTGCAGAAGACACTATTTGCTGTTAAGTGTTGAACTTTGT
GTATGGATCCCTTTATAAAGCTATCGTAATTTATGCTGTTGCTTAAAGCAAATAACTTTTTTTCTGTCTTCCAGATCCAAAGCATTCA
TCAGCTGATCAGACATTTCTTCTTCCGCAAATATGAAGAGGGAAGATATGATATTAGCCAAACCTCTACGATATTTCACCTACCCGA
GATAACAGGGCATCACCTACTGGATGTGTACAAAAAAACTCTTATACAGCATGGAGGTTATCATCACACCAGCAGTCGCCAACCACT
ATCGGCAGTTGAACTACAGGAGGCGGGCGTAATTTTCCAGTGCAGTGAAACGCTGTCATTGACAGATATATGCTTCACCAAAGGTGT
CCTTTGCCTACCTGCAGTCGACGTTGACGAAGCATTTGAAGTTGTTATGCGGAATCTCATTGCCTATGAGCAAGCACATGGCGAAGG
TCAAGAGGTAACATCCTATGTGTTTTTTATGGATGGCATTGTAAACAATGACAAAGATATTGCCTTGCTTCGAGAGAAGGGTATTAT
CAGGTCGGGGGTAAGCAGTGATAAGAGGATAGCCGATCTTTTTAATGGACTGACAAAAGGTATAGTTGCAAAAGTTGTCGACAATGT
TGATGTTGATGTAACCAAGGACATCAATGAGTATTGCAATAGAAGATGGAACAGGTGGCAAGCCAACTTTAAGCAGAGATACTTTGC
GAATCCATGGGTAACTTGCTCACTCATTGTAGGAGCTCTAGTATTAGGTCTCACCATCACTCAAACAATCTATGGCATCCTTTCTTA
TAATAAGTGTAGTTAATGTAACTCTCATACTCGAAAATGTATGGATGATTCCAGTCTTGATCCCAGTCTTTTGTCATGGCTGTGTGG
CTGTAAGCATTGTAATTTGAGACAATGACAAGGATGAATAGGCTAATATCAACTGAAAAAGCTTCATATTTTTTTTGGTTTTTGCTC
AAGATTGAATAAAAATGG
>12_25M GDS gene region
ATGTCTGAAGCCTGGGTTTCTCGATTGACATCGGATATAGGGTGGCTCAATAGCACAAATGCCCTGATGGCGGAGGCCTGGAGTCGT
CATTCAATCTACGACGTACCAGACACATTCAAAAGGATTAGCCCACAGATCCATAAGCCATCAACGTGCAGCATTGGACCACGGTAC
AATGGAGATCTGAATCTCCTTCGTATGGAACGTCATAAACACAGGGCGCTACTGAACTTCCTCATCCGATGTCAAGTGTCGATCCAT
GACATCATACGAGCCCTGAGGAAGAACCTGCACGATTTCAGAGCCTGCTATCAAGATCTTGACACCTTTTGGATGAAGAATGATGAT
GAGTTCCTAAAAATCATGATTTACGATGGGGCTTTCATGATTGAAATCATGATAGCGACCGTTGAACCATATGAGCGCACACCTTCT
AGCTATCATGCCAAGGACCCAATATTCAAGAAGCCATACTTGGTCGAAGATCTTCGTGTAGATATGCTCAGGTTGGATAATCAAATT
CCAATGAAGGTCCTGGAGATATTGTCTAAATTCTGCAAGAACAAGGTAAGGAATGTTAATGAAATCTAAATCTTCATACCTTGAAAT
GTCCCAGCTGTAACTCCAGAAGAACTTGCACAAAATTTTCATACCTCGTAATGCAAGATTAACCTAACAGTCAACGTTGTATGAAAT
GATACATTATGCAAGGAGGATACTCGCACAAAATTTGCTATCCATTGAAGATATCATTCCCATGAGATTTTTTTGCAAATAAATGAG
TAATGTGCATGCTCAAGAAAGCAGTCACCATATTGAAATCATGCAGAAGACACTATTTGCATATACATCATATATGCTCTATTGAAC
TAAGACCTGGATAAATAACTTCTGGATAGATAAACTTTATTGAAATCCTGCAGAAGACACTATTTGCTGTTAAGTGTTGAACTTTGT
GTATGGATCCCTTTATAAAGCTATCGTAATTTATGCTGTTGCTTAAAGCAAATAACTTTTTTTCTGTCTTCCAGATCCAAAGCATTC
ATCAGCTGATCAGACATTTCTTCTTCCGCAAATATGAAGAGGGAAGATATGATATTAGCCAAACCTCTACGATATTTCACCTACCCG
AGATAACAGGGCATCACCTACTGGATGTGTACAAAAAAACTCTTATACAGCATGGAGGTTATCATCACACCAGCAGTCGCCAACCAC
TATCGGCAGTTGAACTACAGGAGGCGGGCGTAATTTTCCAGTGCAGTGAAACGCTGTCATTGACAGATATATGCTTCACCAAAGGTG
TCCTTTGCCTACCTGCAGTCGACGTTGACGAAGCATTTGAAGTTGTTATGCGGAATCTCATTGCCTATGAGCAAGCACATGGCGAAG
GTCAAGAGGTAACATCCTATGTGTTTTTTATGGATGGCATTGTAAACAATGACAAAGATATTGCCTTGCTTCGAGAGAAGGGTATTA
TCAGGTCGGGGGTAAGCAGTGATAAGAGGATAGCCGATCTTTTTAATGGACTGACAAAAGGTATAGTTGCAAAAGTTGTCGACAATG
TTGATGTTGATGTAACCAAGGACATCAATGAGTATTGCAATAGAAGATGGAACAGGTGGCAAGCCAACTTTAAGCAGAGATACTTTG
CGAATCCATGGGTAACTTGCTCACTCATTGTAGGAGCTCTAGTATTAGGTCTCACCATCACTCAAACAATCTATGGCATCCTTTCTT
ATAATAAGTGTAGTTAATGTAACTCTCATACTCGAAAATGTATGGATGATTCCAGTCTTGATCCCAGTCTTTTGTCATGGCTGTGTG
GCTGTAAGCATTGTAATTTGAGACAATGACAAGGATGAATAGGCTAATATCAACTGAAAAAGCTTCATATTTTTTTTGGTTTTTGCT
CAAGATTGAATAAAAATGGCTTTAAAAAGGTAATGTGTAAC
>K323 GDS gene region
ATGTCTGAAGCCTGGGTTTCTCGATTGACATCGGATATAGGGTGGCTCAATAGCACAAATGCCCTGATGGCGGAGGCCTGGAGTCGT
CATTCAATCTACGACGTACCAGACACATTCAAAAGGATTAGCCCACAGATCCATAAGCCATCAACGTGCAGCATTGGACCACGGTAC
AATGGAGATCTGAATCTCCTTCGTATGGAACGTCATAAACACAGGGCGCTACTGAACTTCCTCATCCGATGTCAAGTGTCGATCCAT
GACATCATACGAGCCCTGAGGAAGAACCTGCACGATTTCAGAGCCTGCTATCAAGATCTTGACACCTTTTGGATGAAGAATGATGAT
GAGTTCCTAAAAATCATGATTTACGATGGGGCTTTCATGATTGAAATCATGATAGCGACCGTTGAACCATATGAGCGCACACCTTCT
AGCTATCATGCCAAGGACCCAATATTCAAGAAGCCATACTTGGTCGAAGATCTTCGTGTAGATATGCTCAGGTTGGATAATCAAATT
CCAATGAAGGTCCTGGAGATATTGTCTAAATTCTGCAAGAACAAGGTAAGGAATGTTAATGAAATCTAAATCTTCATACCTTGAAAT
GTCCCAGCTGTAACTCCAGAAGAACTTGCACAAAATTTTCATACCTCGTAATGCAAGATTAACCTAACAGTCAACGTTGTATGAAAT
GATACATTATGCAAGGAGGATACTCGCACAAAATTTGCTATCCATTGAAGATATCATTCCCATGAGATTTTTTTGCAAATAAATGAG
TAATGTGCATGCTCAAGAAAGCAGTCACCATATTGAAATCATGCAGAAGACACTATTTGCATATACATCATATATGCTCTATTGAAC
TAAGACCTGGATAAATAACTTCTGGATAGATAAACTTTATTGAAATCCTGCAGAAGACACTATTTGCTGTTAAGTGTTGAACTTTGT
GTATGGATCCCTTTATAAAGCTATCGTAATTTATGCTGTTGCTTAAAGCAAATAACTTTTTTTCTGTCTTCCAGATCCAAAGCATTC
ATCAGCTGATCAGACATTTCTTCTTCCGCAAATATGAAGAGGGAAGATATGATATTAGCCAAACCTCTACGATATTTCACCTACCCG
AGATAACAGGGCATCACCTACTGGATGTGTACAAAAAAACTCTTATACAGCATGGAGGTTATCATCACACCAGCAGTCGCCAACCAC
TATCGGCAGTTGAACTACAGGAGGCGGGCGTAATTTTCCAGTGCAGTGAAACGCTGTCATTGACAGATATATGCTTCACCAAAGGTG
TCCTTTGCCTACCTGCAGTCGACGTTGACGAAGCATTTGAAGTTGTTATGCGGAATCTCATTGCCTATGAGCAAGCACATGGCGAAG

Fig. 13DH

GTCAAGAGGTAACATCCTATGTGTTTTTTATGGATGGCATTGTAAACAATGACAAAGATATTGCCTTGCTTCGAGAGAAGGGTATTA
TCAGGTCGGGGGTAAGCAGTGATAAGAGGATAGCCGATCTTTTTAATGGACTGACAAAAGGTATAGTTGCAAAAGTTGTCGACAATG
TTGATGTTGATGTAACCAAGGACATCAATGAGTATTGCAATAGAAGATGGAACAGGTGGCAAGCCAACTTTAAGCAGAGATACTTTG
CGAATCCATGGGTAACTTGCTCACTCATTGTAGGAGCTCTAGTATTAGGTCTCACCATCACTCAAACAATCTATGGCATCCTTTCTT
ATAATAAGTGTAGTTAATGTAACTCTCATACTCGAAAATGTATGGATGATTCCAGTCTTGATCCCAGTCTTTTGTCATGGCTGTGTG
GCTGTAAGCATTGTAATTTGAGACAATGACAAGGATGAATAGGCTAATATCAACTGAAAAAGCTTCATATTTTTTTTGGTTTTTGCT
CAAGATTGAATAAAAATGGCTTTAAAAAGGTAATGTGTAACAATGTCTCAGATTTTATTCTTTCCACACCCTGAACTCAACTTGGTT
GCTTCTGTGCCCAAGTCAAATATTAATAAAACCATGTGCCTTTCTTGCAAGATCTTGGATTTTGTTCGGGTGCCATTTAATAAGAGA
AGCTTGAAGGCATCCCTTTGCATTACCCAAATGGAATCTGGGAGCTATGTTTTAATTACATTTAAATAGTGGCTCTTTGAGGGTGTT
TGTCTTTCAAATGTTCAGTTCCATGTCTTACTTCCAGTTATAATTTTTTCTAGTGTAGTGATACTCTTAGTTTCTGTTCATGATTTA
ATGCATAGTATCTGGCAACCAATAAATGCAAATGCATTAGTGTCGATCACATAACAAGAAATGATTAGTTCTTCGAGCCAATTTAAT
TTTCTCTGTTATTCCTTGATTTCCAAAACTTTGTTATTGTTTTGTCTTATCTGATCTCAGTCTTTCTTTGCAGGCCTTTCCCGGGAT
TCATAAATGTTGATCTCAACGGTAGGGTTTCGTGCTGGGGTTTGAGTATCTGTGGAGCATTTAGTGTGAGAAAACTGTGCTTAATTT
CGCTTCTCCACTATGAGAGTGGAGGAGCACAACTAATGGTATCCAGTGTAAATTTAACTCTTTGTTTGTGGCTTGAGAACAACATGT
TCTTTATATAGCCTTTGACAATGTAATAGATAACATCAACTTCTTTGATACATACTAGCGATATTAGCATCCTATCTTTTTCTTCTT
CATGTTAACAATCCTATAGCCTTTACACGGGTAATATATCCTTGTGATGTTTAATCCTAAGTTTTTCTCTGGTCAGTGAATATGAAC
AGCAGCTATTAT
>S375 GDS gene region [mutant]
ATGTCTGAAGCCTGGGTTTCTCGATTGACATCGGATATAGGGTGGCTCAATAGCACAAATGCCCTGATGGCGGAGGCCTGGAGTCGT
CATTCAATCTACGACGTACCAGACACATTCAAAAGGATTAGCCCACAGATCCATAAGCCATCAACGTGCAGCATTGGACCACGGTAC
AATGGAGATCTGAATCTCCTTCGTATGGAACGTCATAAACACAGGGCGCTACTGAACTTCCTCATCCGATGTCAAGTGTCGATCCAT
GACATCATACGAGCCCTGAGGAAGAACCTGCACGATTTCAGAGCCTGCTATCAAGATCTTGACACCTTTTGGATGAAGAATGATGAT
GAGTTCCTAAAAAATCATGATTTACGATGGGGCTTTCATGATTGAAATCATGATAGCGACCGTTGAACCATATGAGCGCACACCTTCT
AGCTATCATGCCAAGGACCCAATATTCAAGAAGCCATACTTGGTCGAAGATCTTCGTGTAGATATGCTCAGGTTGGATAATCAAATT
CCAAGAAGGTCCTGGAGATATTGTCTAAATTCTGCAAGAACAAGGTAAGGAATGTTAATGAAATCTAAATCTTCATACCTTGAAATG
TCCCAGCTGTAACTCCAGAAGAACTTGCACAAAATTTTCATACCTCGTAATGCAAGATTAACCTAACAGTCAACGTTGTATGAAATG
ATACATTATGCAAGGAGGATACTCGCACAAAATTTGCTATCCATTGAAGATATCATTCCCATGAGATTTTTTTGCAAATAAATGAGT
AATGTGCATGCTCAAGAAAGCAGTCACCATATTGAAATCATGCAGAAGACACTATTTGCATATACATCATATATGCTCTATTGAACT
AAGACCTGGATAAATAACTTCTGGATAGATAAACTTTATTGAAATCCTGCAGAAGACACTATTTGCTGTTAAGTGTTGAACTTTGTG
TATGGATCCCTTTATAAAGCTATCGTAATTTATGCTGTTGCTTAAAGCAAATAACTTTTTTTCTGTCTTCCAGATCCAAAGCATTCA
TCAGCTGATCAGACATTTCTTCTTCCGCAAATATGAAGAGGGAAGATATGATATTAGCCAAACCTCTACGATATTTCACCTACCCGA
GATAACAGGGCATCACCTACTGGATGTGTACAAAAAACTCTTATACAGCATGGAGGTTATCATCACACCAGCAGTCGGCAACCACT
ATCGGCAGTTGAACTACAGGAGGCGGGCGTAATTTTCCAGTGCAGTGAAACGCTGTCATTGACAGATATATGCTTCACCAAAGGTGT
CCTTTGCCTACCTGCAGTCGACGTTGACGAAGCATTTGAAGTTGTTATGCGGAATCTCATTGCCTATGAGCAAGCACATGGCGAAGG
TCAAGAGGTAACATCCTATGTGTTTTTTATGGATGGCATTGTAAACAATGACAAAGATATTGCCTTGCTTCGAGAGAAGGGTATTAT
CAGGTCGGGGGTAAGCAGTGATAAGAGGATAGCCGATCTTTTTAATGGACTGACAAAAGGTATAGTTGCAAAAGTTGTCGACAATGT
TGATGTTGATGTAACCAAGGACATCAATGAGTATTGCAATAGAAGATGGAACAGGTGGCAAGCCAACTTTAAGCAGAGATACTTTGC
GAATCCATGGGTAACTTGCTCACTCATTGTAGGAGCTCTAGTATTAGGTCTCACCATCACTCAAACAATCTATGGCATCCTTTCTTA
TAATAACTGTAGTTAATGTAACTCTCATACTCGAAAATGTATGGATGATTCCAGTCTTGATCCCAGTCTTTTGTCATGGCTGTGTGG
CTGTAAGCATTGTAATTTGAGACAATGACAAGGATGAATAGGCTAATATCAACTGAAAAAGCTTCATATTTTTTTTGGTTTTTGCTC
AAGATTGAATAAAAATGGCTTTAAAAAGGTAATGTGTAACAATGTCTCAGATTTTATTCTTTCCACACCCTGAACTCAACTTGGTTG
CTTCTGTGCCCAAGTCAAATATTAATAAAACCATGTGCCTTTCTTGCAAGATCTTGGATTTTGTTCGGGTGCCATTTAATAAGAGAA
GCTTGAAGGCATCCCTTTGCATTACCCAAATGGAATCTGGGAGCTATGTTTTAATTACATTTAAATAGTGGCTCTTTGAGGGTGTTT
GTCTTTCAAATGTTCAGTTCCATGTCTTACTTCCAGTTATAATTTTTTCTAGTGTAGTGATACTCTTAGTTTCTGTTCATGATTTAA
TGCATAGTATCTGGCAACCAATAAATGCAAATGCATTAGTGTCGATCACATAACAAGAAATGATTAGTTCTTCGAGCCAATTTAATT
TTCTCTGTTATTCCTTGATTTCCAAAACTTTGTTATTGTTTTGTCTTATCTGATCTCAGTCTTTCTTTGCAGGCCTTTCCCGGGATT
CATAAATGTTGATCTCAACGGTAGGGTTTCCTGCTGGGGTTTGAGTATCTGTGGAGCATTTAGTGTGAGAAAACTGTGCTTAATTTC
GCTTCTCCACTATGAGAGTGGAGGAGCACAACTAATGGTATCCAGTGTAAATTTAACTCTTTGTTTGTGGCTTGAGAACAACATGTT
CTTTATATAGCCTTTGACAATGTAATAGATAACATCAACTTCTTTGATACATACTAGCGATATTAGCATCCTATCTTTTTCTTCTTC
ATGTTAACAATCCTATAGCCTTTACACGGGTAATATATCCTTGTGATGTTTAATCCTAAGTTTTTCTCTGGTCAGTGAATATGAACA
GCAGCTATTATTTTATTGC
>K323_G033 GDS gene region [mutant]
TGCAGCATTGGACCACGGTACAATGGAGATCTGAATCTCCTTCGTATGGACGTCATAAACACAGGGCGCTACTGAACTT
CCTCATCCGATGTCAAGTGTCGATCCATGACATCATACGAGCCCTGAGGAAGAACCTGCACGATTTCAGAGCCTGCTAT
CAAGATCTTGACACCTTTTGGATGAAGAATGATGATGAGTTCCTAAAAATCATGATTTACGATGGGGCTTTCATGATTG
AAATCATGATAGCGACCGTTGAACCATATGAGCGCACACCTTCTAGCTATCATGCCAAGGACCCAATATTCAAGAAGCC
ATACTTGGTCGAAGATCTTCGTGTAGATATGCTCAGGTTGGATAATCAAATTCCAATGAAGGTCCTGGAGATATTGTCT
AAATTCTGCAAGAACAAGGTAAGGAATGTTAATGAAATCTAAATCTTCATACCTTGAAATGTCCCAGCTGTAACTCCAG
AAGAACTTGCACAAAATTTTCCTTATTCCTTATTCCTTATTCCTTGCAGTTATATACGTTATAGCGGATCCCATCCATC
GGCTCCAAAGCTTCGGCCAGCTGTCGAGCAAGACGTTGACGCTGTCTTTGTCRTGCTCTCTTTGT Line 88
female tester 861BC1d;
hermaphrodite vs. male sibling
ID:377152 ID:377154

CHG Methylation and Read Coverage K1036 vs 9M Scaffolf_905

Fig. 18

>reconstructed MYB34-like of AsOf_V2.0_scaffold436

ATGGGCAGGCCTCCATGCTGCGATAAATCCAACGTGAAGAAGGGACTTTGGACTGAGGAAGAAGATTTGAAGCTAATAGCTTATACCAACACTC
ATGGAATAGGAAATTGGACTTCTGTTCCAAAGAAAGCAGgttcttttacgtagctaattggttgattttcttcaaaataatatttacgttatt
gatttttatttatttattggtaatgtgagtatgcaattttagGGTTGAAGAGATGTGGAAGAGCTGTAGGCTAAGATGGACTAATTATCTGC
GCCCTAATTTGAAGCATGAGAGCTTCACTCAACAAGAAGAGGAGATGATTATAACACTTCATGCTACAATCGGAAGCCGgtattgttctctcta
tcaatttatttgattgaggattttatatcatgatgttaactactgtagttttcattttagtcaattaggaacattattttgtttgaatagtttt
aacctagaaagaatttctagtgtagagctgctaacacaaatatctttacactgtccagatattaaagcggggctgaaatagtaaaaaggaggag
gaggaaaatatctataactatatatgacaaccccagtttgaaattgattttaaacataattttatctagaagtgagatggacaggcatcaaaaa
cctgtacttttgaaatgtagaatgtaaattaactcaacaataggatatttatacatttgaaattttcatatttgaaatcttctatgttgagtta
atctatgattatcatctggggtccacagaaattgaaaacatttggttttggaacagaattctagtttcaaatgacagaaagatcttttataatc
tcaaaatgatgagtagttctattaattagtttttgcttactatttcagaagtttaccaaaagaccagtttgttttgttgaatttacatcaagat
gagtagattgtctcttttgccagtttccctactcattttatcattcactaatgagtaatgagtagctaaattgtttaatattgcacaataggta
taaactgctaatttcatgggtaaattacactaaaccccataaactttcagtgctttgtagtaaacacagtaaactttcaaaatcacactaaaa
tcccaataacttttgcagagaacttctatgaacttctatggtaaattatactaaaccctcatgaactttcaaaataccttttttatgttattttt
ttgttctaatttggggattatctacaaaactcagaaaaatcatgggcgctctttgcaattccaaaaagttcattggggtttagtgttatttg
aaaattcattgggatatattgcaaaactctaaaagttcaagggtttattgtaatttaccctaatttaatattgcacattattgtccccttttga
atgaaatgggctaattaaggcttatatttcctttcgttatcatgagatttgaaagaactattggtgtaaaggaagctacggtagctaaaagttt
ggattagttaaagagtcatctaattaccttagaattaaagctaccggcatatttcaatttcgtgattggaggcagtatgaaagtgatgatccct
atctcctaacaaatttaactaaccatgacgtacacacgatcactccccctcactctctccaacagtcacaattatattccttttagtacttaa
ttatgtacataacaccatgattatttttagtacagGTGGTCGGTAATCGCACATCACCTCCCGGGTCGAACAGACAACGACATAAAGAACCACT
GGAACACAAAACTGAGCAAAAAACTGTGCCAGCAAGGCATCGACCCCGTCACCCACAAACCCATCTCTCAAATCAAGGAAACCATCACCACTCT
AGCCGCCGCCGCCGCCGCCAACCACCACCTCCTAATCCACCCTCCACCCTTCAACACCCGCGTCAACAGCTGCCTGAGCCGCGACCTCAAGAAC
GTCCTCCTCTCCAAACCGCAACAATTCTACGAACCAACAACAGCCACAAGCACCACATTGGATGAGGTTTATAAGCAGGATAAGGAGATCAAAT
GGAGCGATTATCTCGTCGACGATGTTTTCGTGCCGAACCAAGAGAAGGAATTGGTGGTGAATGGATATGGGAAGGAGAAGGTGACAAGTGCAGT
GGATGAGGAGGTGAGTAGTACTGTGTTTGGAGGTGAAGGGAGTAGTAGCTCGAGTTCTTTTGTGGAGGGAATATTAGATCAGGGGAGGGAGATG
ATGATGGAGTTCCCTGAGTTTTTTTATGATTTGCTGTAG

Fig. 19

>reconstructed MYB34-like of AsOf_V2.0_scaffold436 PROTEIN

MGRPPCCDKSNVKKGLWTEEEDLKLIAYTNTHGIGNWTSVPKKAGLKRCGKSCRLRWTNYLRPNLKHESFTQQEE
EMIITLHATIGSRWSVIAHHLPGRTDNDIKNHWNTKLSKKLCQQGIDPVTHKPISQIKETITTLAAAAAANHHLL
IHPPPFNTRVNSCLSRDLKNVLLSKPQQFYEPTTATSTTLDEVYKQDKEIKWSDYLVDDVFVPNQEKELVVNGYG
KEKVTSAVDEEVSSTVFGGEGSSSSSSFVEGILDQGREMMMEFPEFFYDLL

Fig. 20A

```
>lcl|AsOf_v2.0_scaffold1220  Download lcl|AsOf_v2.0_scaffold1220

Length=307437

Score = 72.4 bits (176), Expect(3) = 3e-36, Method: Compositional matrix adjust.

 Identities = 31/45 (69%), Positives = 36/45 (80%), Gaps = 0/45 (0%)

 Frame = -1

Query 44    AGLNRCGKSCRLRWTNYLRPDLKSDSFSTQEEELIIECHRAIGSR 88

        +GL RCGKSCRLRW NYLRPDLK +FS QEE LII+ H +G+R


Sbjct 158364 SGLQRCGKSCRLRWINYLRPDLKRGTFSQQEENLIIDLHAVLGNR 158230

 Score = 58.6 bits (140), Expect(3) = 3e-36, Method: Compositional matrix adjust.

 Identities = 30/47 (64%), Positives = 38/47 (81%), Gaps = 0/47 (0%)

 Frame = -3


Query 88    RWSSIARKLPGRTDNDVKNHWNTKLKKKLMKRGIDPVTHKPVSQLLA 134

        RWS IA +LPGRTDN++KN WN+ +KKKL + GIDP THKP+S+ A

Sbjct 158195 RWSQIAAQLPGRTDNEIKNLWNSCIKKKLRQRGIDPNTHKPLSETEA 158055


 Score = 55.1 bits (131), Expect(3) = 3e-36, Method: Compositional matrix adjust.

 Identities = 23/45 (52%), Positives = 32/45 (72%), Gaps = 0/45 (0%)

 Frame = -2


Query 1     MGRPPCCDKSNVKKGLWTSEEDAKILAYVAIHGVGNWSLIPKKAG 45

        MGR CC K ++KGLW+ EED K+L ++ +G G WS +P++AG

Sbjct 158573 MGRHSCCYKQKLRKGLWSPEEDEKLLRHITKYGHGCWSSVPRQAG 158439
```

Fig. 20B

```
lcl|AsGf_v2.0_scaffold436  Download lcl|AsGf_v2.0_scaffold436

Length=496167

 Score = 85.1 bits (209), Expect(3) = 2e-33, Method: Compositional matrix adjust.

 Identities = 38/49 (78%), Positives = 40/49 (89%), Gaps = 0/49 (0%)

 Frame = -3


Query 1     MGRPFCCDKSNVKKGLWTEEEDAKILAYVAISGVGNWSLIPKKAG 45

        MGRPPCCDKSNVKKGLWTEEED K++AY  HG+GNW+ +PKKAG

Sbjct 401099 MGRPPCCDKSNVKKGLWTSEEDLKLIAYTNTHGIGNWTSVPKKAG 400935




 Score = 81.3 bits (199), Expect(2) = 2e-33, Method: Compositional matrix adjust.

 Identities = 35/48 (73%), Positives = 41/48 (86%), Gaps = 0/48 (0%)

 Frame = -2

Query 45    GLNRCGKSCRLRWTNYLRPDLKRDSFSTQEEKLIIECHRAIGGRWSSI 92

        GL RCGKSCRLRWTNYLRP+LKS+SF+ QEE+II H IGSR+ S+

Sbjct 400829 GLKRCGKSCRLRWTNYLRPNLKHESFTQQEEMIITLHATIGSRYCSL 400686

 Score = 81.3 bits (199), Expect = 3e-16, Method: Compositional matrix adjust.

 Identities = 35/45 (78%), Positives = 39/45 (87%), Gaps = 0/45 (0%)

 Frame = -3

Query 88    RWSSIARRLPGRTDNDVKNHWNTKLKKKLMKMGIDPVTHKPVSQL 132

        RWS IA LPGRTDN+ KNHWNTKL KKL + GIDPVTHKP+SQ+

Sbjct 399334 RWSVIAHHLPGRTGNDIKNHWNTKLSKKLCQQGIDPVTHKPISQI 399200
```

Fig. 21

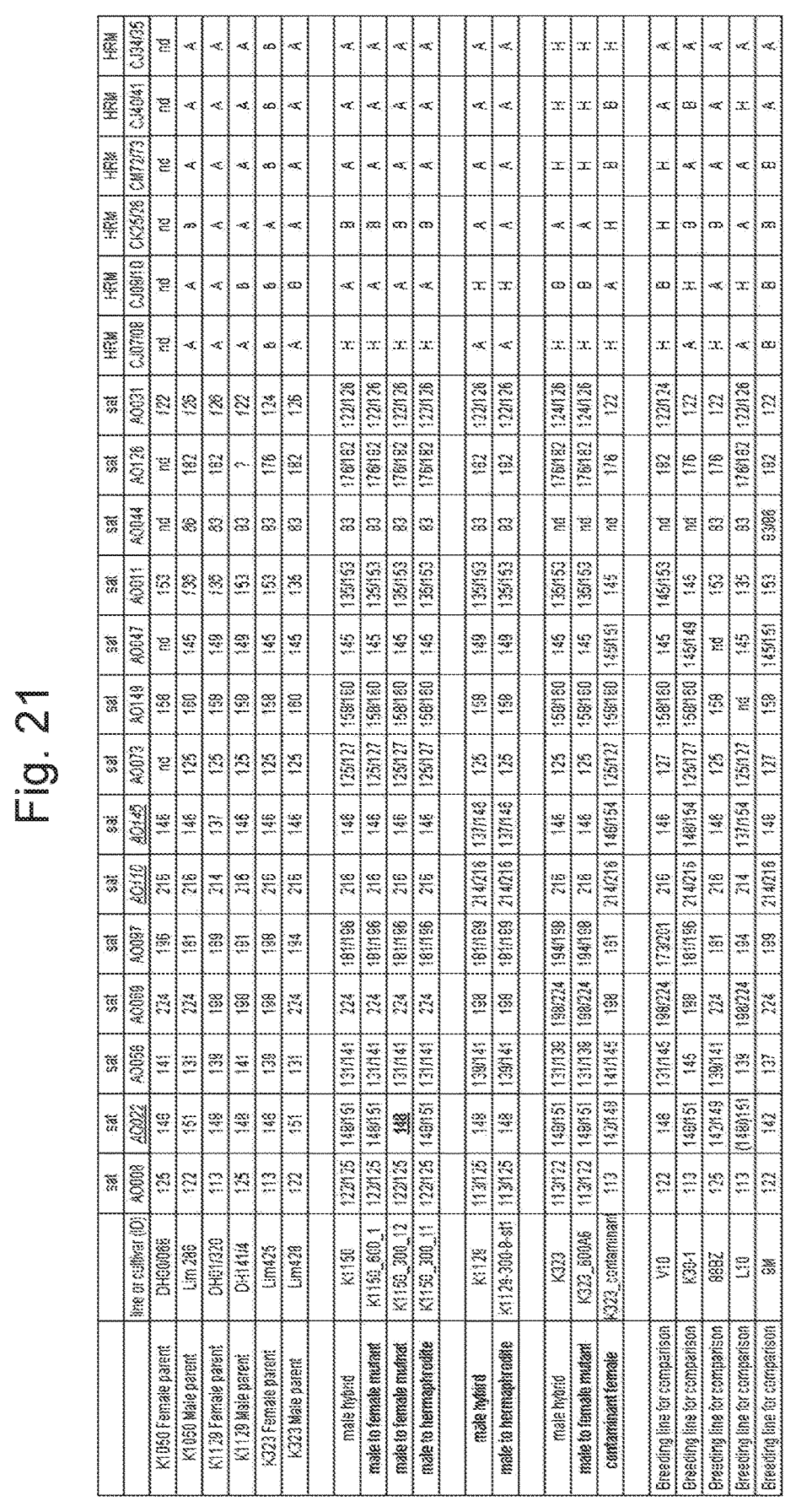

| | | sat | sat | sat | sat | sat | sat | sat | sat | sat | sat | sat | sat | sat | sat | HRM | HRM | HRM | HRM | HRM | HRM |
|---|---|---|---|---|---|---|---|---|---|---|---|---|---|---|---|---|---|---|---|---|---|
| | line or cultivar (ID) | AO008 | AO022 | AO056 | AO069 | AO097 | AO110 | AO145 | AO073 | AO149 | AO047 | AO011 | AO044 | AO128 | AO031 | CJ07/08 | CJ09/10 | CK25/26 | CM72/73 | CJ40/41 | CJ34/35 |
| K1050 Female parent | DH00/088 | 125 | 148 | 141 | 224 | 196 | 216 | 146 | nd | 158 | nd | 153 | nd | nd | 122 | nd | nd | nd | nd | nd | nd |
| K1050 Male parent | Lim 286 | 122 | 151 | 131 | 224 | 181 | 216 | 146 | 125 | 160 | 145 | 135 | 86 | 182 | 126 | A | A | B | A | A | A |
| K1129 Female parent | DH01/320 | 113 | 148 | 139 | 198 | 189 | 214 | 137 | 125 | 158 | 149 | 135 | 83 | 182 | 126 | A | A | A | A | A | A |
| K1129 Male parent | DH141/4 | 125 | 148 | 141 | 198 | 191 | 216 | 146 | 125 | 158 | 149 | 153 | 83 | ? | 122 | A | B | A | A | A | A |
| K323 Female parent | Lim425 | 113 | 148 | 139 | 198 | 198 | 216 | 146 | 125 | 158 | 145 | 153 | 83 | 176 | 124 | B | B | A | B | B | B |
| K323 Male parent | Lim428 | 122 | 151 | 131 | 224 | 194 | 216 | 146 | 125 | 160 | 145 | 135 | 83 | 182 | 126 | A | B | A | A | A | A |
| | | | | | | | | | | | | | | | | | | | | | |
| male hybrid | K1150 | 122/125 | 148/151 | 131/141 | 224 | 181/196 | 216 | 146 | 125/127 | 158/160 | 145 | 135/153 | 83 | 176/182 | 122/126 | H | A | B | A | A | A |
| **male to female mutant** | K1150_600_1 | 122/125 | 148/151 | 131/141 | 224 | 181/196 | 216 | 146 | 125/127 | 158/160 | 145 | 135/153 | 83 | 176/182 | 122/126 | H | A | B | A | A | A |
| **male to female mutnat** | K1150_300_12 | 122/125 | **148** | 131/141 | 224 | 181/196 | 216 | 146 | 125/127 | 158/160 | 145 | 135/153 | 83 | 176/182 | 122/126 | H | A | B | A | A | A |
| **male to hermaphrodite** | K1150_300_11 | 122/125 | 148/151 | 131/141 | 224 | 181/196 | 216 | 146 | 125/127 | 158/160 | 145 | 135/153 | 83 | 176/182 | 122/126 | H | A | B | A | A | A |
| | | | | | | | | | | | | | | | | | | | | | |
| **male hybird** | K1129 | 113/125 | 148 | 139/141 | 198 | 181/189 | 214/216 | 137/146 | 125 | 158 | 149 | 135/153 | 83 | 182 | 122/126 | A | H | A | A | A | A |
| **male to hermaphrodite** | K1129-300-8-st1 | 113/125 | 148 | 139/141 | 198 | 181/189 | 214/216 | 137/146 | 125 | 158 | 149 | 135/153 | 83 | 182 | 122/126 | A | H | A | A | A | A |
| | | | | | | | | | | | | | | | | | | | | | |
| male hybrid | K323 | 113/122 | 148/151 | 131/139 | 198/224 | 194/198 | 216 | 146 | 125 | 158/160 | 145 | 135/153 | nd | 176/182 | 124/126 | H | B | A | H | H | H |
| **male to female mutant** | K323_600A6 | 113/122 | 148/151 | 131/139 | 198/224 | 194/198 | 216 | 146 | 125 | 158/160 | 145 | 135/153 | nd | 176/182 | 124/126 | H | B | A | H | H | H |
| **contaminant female** | K323_contaminant | 113 | 142/149 | 141/145 | 198 | 181 | 214/216 | 146/154 | 125/127 | 158/160 | 145/151 | 145 | nd | 176 | 122 | H | A | H | B | B | H |
| | | | | | | | | | | | | | | | | | | | | | |
| Breeding line for comparison | V10 | 122 | 148 | 131/145 | 198/224 | 173/201 | 216 | 146 | 127 | 158/160 | 145 | 145/153 | nd | 182 | 122/124 | H | B | H | H | A | A |
| Breeding line for comparison | K30-1 | 113 | 148/151 | 145 | 198 | 181/196 | 214/216 | 146/154 | 125/127 | 158/160 | 145/149 | 145 | nd | 176 | 122 | A | H | B | A | B | A |
| Breeding line for comparison | 88BZ | 125 | 142/149 | 139/141 | 224 | 181 | 216 | 146 | 125 | 158 | nd | 153 | 83 | 176 | 122 | H | A | B | A | A | A |
| Breeding line for comparison | L10 | 113 | (148)/151 | 139 | 198/224 | 194 | 214 | 137/154 | 125/127 | nd | 145 | 135 | 83 | 176/182 | 122/126 | A | H | A | A | H | A |
| Breeding line for comparison | 9M | 122 | 142 | 137 | 224 | 199 | 214/216 | 148 | 127 | 158 | 145/151 | 153 | 83/86 | 182 | 122 | B | B | B | B | A | A |

AS-TDF1 scaffold 436

Gyncioum suppressor (DUF247) scaffold 905

Fig. 24A

>SEQ ID NO:1; GDS infered cDNA sequence

ATGTCTGAAGCCTGGGTTTCTCGATTGACATCGGATATAGGGTGGCTCAATAGCACAAATGCCCTGATGGCGGAG
GCCTGGAGTCGTCATTCAATCTACGACGTACCAGACACATTCAAAAGGATTAGCCCACAGATCCATAAGCCATCA
ACGTGCAGCATTGGACCACGGTACAATGGAGATCTGAATCTCCTTCGTATGGAACGTCATAAACACAGGGCGCTA
CTGAACTTCCTCATCCGATGTCAAGTGTCGATCCATGACATCATACGAGCCCTGAGGAAGAACCTGCACGATTTC
AGAGCCTGCTATCAAGATCTTGACACCTTTTGGATGAAGAATGATGATGAGTTCCTAAAAATCATGATTTACGAT
GGGGCTTTCATGATTGAAATCATGATAGCGACCGTTGAACCATATGAGCGCACACCTTCTAGCTATCATGCCAAG
GACCCAATATTCAAGAAGCCATACTTGGTCGAAGATCTTCGTGTAGATATGCTCAGGTTGGATAATCAAATTCCA
ATGAAGGTCCTGGAGATATTGTCTAAATTCTGCAAGAACAAGATCCAAAGCATTCATCAGCTGATCAGACATTTC
TTCTTCCGCAAATATGAAGAGGGAAGATATGATATTAGCCAAACCTCTACGATATTTCACCTACCCGAGATAACA
GGGCATCACCTACTGGATGTGTACAAAAAAACTCTTATACAGCATGGAGGTTATCATCACACCAGCAGTCGCCAA
CCACTATCGGCAGTTGAACTACAGGAGGCGGGCGTAATTTTCCAGTGCAGTGAAACGCTGTCATTGACAGATATA
TGCTTCACCAAAGGTGTCCTTTGCCTACCTGCAGTCGACGTTGACGAAGCATTTGAAGTTGTTATGCGGAATCTC
ATTGCCTATGAGCAAGCACATGGCGAAGGTCAAGAGGTAACATCCTATGTGTTTTTTATGGATGGCATTGTAAAC
AATGACAAAGATATTGCCTTGCTTCGAGAGAAGGGTATTATCAGGTCGGGGGTAAGCAGTGATAAGAGGATAGCC
GATCTTTTTAATGGACTGACAAAAGGTATAGTTGCAAAAGTTGTCGACAATGTTGATGTTGATGTAACCAAGGAC
ATCAATGAGTATTGCAATAGAAGATGGAACAGGTGGCAAGCCAACTTTAAGCAGAGATACTTTGCGAATCCATGG
GCCTTTCCCGGGATTCATAAATGTTGATCTCAACGGTAGGGTTTCGTGCTGGGGTTTGAGTATCTGTGGAGCATT
TAGTGTGAGAAAACTGTGCTTAATTTCGCTTCTGCCACTATGAGAGTGGAGGAGCACAACTAATGGTATCCAGTGT
AAATTTAACTCTTTGTTTGTGGCTTGAGAACAACATGTTCTTTATATAGCCTTTGACAATGTAATAGATAACATC
AACTTCTTTGATACATACTAGCGATATTAGCATCCAAAAAAAAAA

>SEQ ID NO:2; Predicted GDS protein

MSEAWVSRLTSDIGWLNSTNALMAEAWSRHSIYDVPDTFKRISPQIHKPSTCSIGPRYNGDLNLLRMERHKHRAL
LNFLIRCQVSIHDIIRALRKNLHDFRACYQDLDTFWMKNDDEFLKIMIYDGAFMIEIMIATVEPYERTPSSYHAK
DPIFKKPYLVEDLRVDMLRLDNQIPMKVLEILSKFCKNKIQSIHQLIRHFFFRKYEEGRYDISQTSTIFHLPEIT
GHHLLDVYKKTLIQHGGYHHTSSRQPLSAVELQEAGVIFQCSETLSLTDICFTKGVLCLPAVDVDEAFEVVMRNL
IAYEQAHGEGQEVTSYVFFMDGIVNNDKDIALLREKGIIRSGVSSDKRIADLFNGLTKGIVAKVVDNVDVDVTKD
INEYCNRRWNRWQANFKQRYFANPWAFPGIHKC

>SEQ ID NO:3; GDS gene region genomic sequence

GGGCCAACCCCGGACCGGGCCCCGGACTGACGGGCTTTTTGGATTGGCCTAAACATATGCATTTATCTTTAAAAGT
CCATGTTATTTTTATGGGCTTGTTGCAAGCAAGCATGGCGGTAAACTAATCCTGGGTTTCAACATTAGTGCTAGT
AAAGCTTTGCCATCTTTTTTTTTTTTTGCTTTAAAGGGCCAACCCCGGACCGGGCCCCGGACTGACGGGCTTTTTGG
ATTGGCCTAAACATATGCATTTATCTTTAAAAGTCCATGTTATTTTTATGGGCTTGTTGCAAGCAAGCATGGCGG
TAAACTAATCCTGGGTTTCAACATTAGTGCTAGTAAAGCTTTGCCATCTTTTTTTTTTTTTGCTTTAAAGTAATTT
TTTAGTAAACTTTTATTCTTAATAGTTCACAACAACACGAGAACCATACAAGTGAAAGAAATTTTATCCCCAAAA
AATTTCAAATAACCATCTCCAATTTTCACCAAATAATCCATCACAATTATCTATATTATACGCAATTCCACTGTT
TTCTCGATTTTTTAACTTTACAAGTCATTAGATTCCTAGCACACAAAATTACCATTGTTTGTGGGAGGAAAAAAG
GCATATTCTACGGTTACAACCCAAGTCACACGATAATCACATTCTTCAAGCTTATGAGGAAACTTCGTCCTATTC
CCCCAACTTAAATTATTACAAAAAATCAGGAATAAGGAAAAAAGAAAAAATTTCCTTCTCTAAAATTTCAACTAA
GACCATTATCAACTTCTTCCAAATAATTTGTACCCATCATCAGTTTCTACCGTTCTCACTCATCGAAACATAAAT
TTTACAGTTTCTACAAGAATAAAATAAACAAGACTGAGTCATAGAGAGAGGAGAAGATGGCAGCGAGATCGGAGG
AGAAGATCTTGTCGAACTAGTAGGGATGAGCTCAAGGTTGGTGGTGTTGGCACTGGGGGATGGGGAGAGATAGAC
GATGGGATTCGACGGAAAGATGAAGAGGGAGAGGAGGAGGGTTAGGAGAAAGTAGGAGAGGAGGTTGAATCGAAA
GTTGAGAATGACGACGAGCTCGAGAAAGGAGTAGATGGCAGCGAGTTTGAAGGAGAAGATCTTGTCAAACAAGTT
GAGCATGAGCTCAAGGTCGGTAGTGGCGAAGGGCAAGGCGACAGAGTTAGACGGCAGATGCCAAGGAGAAGATGA
AGAGGGAGAGGAGGAGGCTAAGGAGAGAGTAGAAAGAGATGAGGCTGAATCACAAATGGACGAAAGTTATGAGA
TCGAAGAGGGGTCTTTTCGGAATTCTCAAACGACATTTCTTGGGGTAGAGTGAAAAGAGGGCTGAATCAAAAAGA
TGCAATGTATTTGGGGCTAAAATACAAGAGGGAAATAATACCGTGGCTTGAGACACATCAAAGTTTAAATTTTAG
GGCCTTCACACAACTTTCCCAATTTTAAATTCTTGCTCTCCTAACCAAACGCAAAACAAAAGAAAAAAAACCGAA
AAAAAAAGAAGAGAAAAATTAATAACAGGAAGAGGCCGAAAGAGGCTTTTATTTTCCATTTCACTGGTGAGGGAG

FIG. 24B

GAAGATTAACTGAACCTCCCCTTTATACCCTCTAGTTATTCTAGCGACACGAACTCAACTCCAGGTGACAACATT
CATAGAGACGATAAACCTCATCACCTCATATGCACCTTCACAACAATTACCATCTCCTGACAGCAAACCCGCCGG
TCCCATATCAGCCCTCTGCATTCGCCTCCCTTCGAGCTCCCTTCTCAAACCTGTCTTCTCCAAGTTCCAAGATTC
ACCTTCTTGAACAAGATTCAAGAACATGTCTGAAGCCTGGGTTTCTCGATTGACATCGGATATAGGGTGGCTCAA
TAGCACAAATGCCCTGATGGCGGAGGCCTGGAGTCGTCATTCAATCTACGACGTACCAGACACATTCAAAAGGAT
TAGCCCACAGATCCATAAGCCATCAACGTGCAGCATTGGACCACGGTACAATGGAGATCTGAATCTCCTTCGTAT
GGAACGTCATAAACACAGGGCGCTACTGAACTTCCTCATCCGATGTCAAGTGTCGATCCATGACATCATACGAGC
CCTGAGGAAGAACCTGCACGATTTCAGAGCCTGCTATCAAGATCTTGACACCTTTTGGATGAAGAATGATGATGA
GTTCCTAAAAATCATGATTTACGATGGGGCTTTCATGATTGAAATCATGATAGCGACCGTTGAACCATATGAGCG
CACACCTTCTAGCTATCATGCCAAGGACCCAATATTCAAGAAGCCATACTTGGTCGAAGATCTTCGTGTAGATAT
GCTCAGGTTGGATAATCAAATTCCAATGAAGGTCCTGGAGATATTGTCTAAATTCTGCAAGAACAAGGTAAGGAA
TGTTAATGAAATCTAAATCTTCATACCTTGAAATGTCCCAGCTGTAACTCCAGAAGAACTTGCACAAAATTTTCA
TACCTCGTAATGCAAGATTAACCTAACAGTCAACGTTGTATGAAATGATACATTATGCAAGGAGGATACTCGCAC
AAAATTTGCTATCCATTGAAGATATCATTCCCATGAGATTTTTTTGCAAATAAATGAGTAATGTGCATGCTCAAG
AAAGCAGTCACCATATTGAAATCATGCAGAAGACACTATTTGCATATACATCATATATGCTCTATTGAACTAAGA
CCTGGATAAATAACTTCTGGATAGATAAACTTTATTGAAATCCTGCAGAAGACACTATTTGCTGTTAAGTGTTGA
ACTTTGTGTATGGATCCCTTTATAAAGCTATCGTAATTTATGCTGTTGCTTAAAGCAAATAACTTTTTTCTGTCT
TCCAGATCCAAAGCATTCATCAGCTGATCAGACATTTCTTCTTCCGCAAATATGAAGAGGGAAGATATGATATTA
GCCAAACCTCTACGATATTTCACCTACCCGAGATAACAGGGCATCACCTACTGGATGTGTACAAAAAAACTCTTA
TACAGCATGGAGGTTATCATCACACCAGCAGTCGCCAACCACTATCGGCAGTTGAACTACAGGAGGCGGGCGTAA
TTTTCCAGTGCAGTGAAACGCTGTCATTGACAGATATATGCTTCACCAAAGGTGTCCTTTGCCTACCTGCAGTCG
ACGTTGACGAAGCATTTGAAGTTGTTATGCGGAATCTCATTGCCTATGAGCAAGCACATGGCGAAGGTCAAGAGG
TAACATCCTATGTGTTTTTTTATGGATGGCATTGTAAACAATGACAAAGATATTGCCTTGCTTCGAGAGAAGGGTA
TTATCAGGTCGGGGGTAAGCAGTGATAAGAGGATAGCCGATCTTTTTAATGGACTGACAAAAGGTATAGTTGCAA
AAGTTGTCGACAATGTTGATGTTGATGTAACCAAGGACATCAATGAGTATTGCAATAGAAGATGGAACAGGTGGC
AAGCCAACTTTAAGCAGAGATACTTTGCGAATCCATGGGTAACTTGCTCACTCATTGTAGGAGCTCTAGTATTAG
GTCTCACCATCACTCAAACAATCTATGGCATCCTTTCTTATAATAAGTGTAGTTAATGTAACTCTCATACTCGAA
AATGTATGGATGATTCCAGTCTTGATCCCAGTCTTTTGTCATGGCTGTGTGGCTGTAAGCATTGTAATTTGAGAC
AATGACAAGGATGAATAGGCTAATATCAACTGAAAAAGCTTCATATTTTTTTTGGTTTTTGCTCAAGATTGAATA
AAAATGGCTTTAAAAAGGTAATGTGTAACAATGTCTCAGATTTTATTCTTTCCACACCCTGAACTCAACTTGGTT
GCTTCTGTGCCCAAGTCAAATATTAATAAAACCATGTGCCTTTCTTGCAAGATCTTGGATTTTGTTCGGGTGCCA
TTTAATAAGAGAAGCTTGAAGGCATCCCTTTGCATTACCCAAATGGAATCTGGGAGCTATGTTTTAATTACATTT
AAATAGTGGCTCTTTGAGGGTGTTTGTCTTTCAAATGTTCAGTTCCATGTCTTACTTCCAGTTATAATTTTTTCT
AGTGTAGTGATACTCTTAGTTTCTGCTCATGATTTAATGCATAGTATCTGGCAACCAATAAATGCAAATGCATTA
GTGTCGATCACATAACAAGAAATGATTAGTTCTTCGAGCCAATTTAATTTTCTCTGTTATTCCTTGATTTCCAAA
ACTTTGTTATTGTTTTGTCTTATCTGATCTCAGTCTTTCTTTGCAGGCCTTTCCCGGGATTCATAAATGTTGATC
TCAACGGTAGGGTTTCGTGCTGGGGTTTGAGTATCTGTGGAGCATTTAGTGTGAGAAAACTGTGCTTAATTTCGC
TTCTCCACTATGAGAGTGGAGGAGCACAACTAATGGTATCCAGTGTAAATTTAACTCTTTGTTTGTGGCTTGAGA
ACAACATGTTCTTTATATAGCCTTTGACAATGTAATAGATAACATCAACTTCTTTGATACATACTAGCGATATTA
GCATCCTATCTTTTTCTTCTTCATGTTAACAATCCTATAGCCTTTACACGGGTAATATATCCTTGTGATGTTTAA
TCCTAAGTTTTTCTCTGGTCAGTGAATATGAACAGCAGCTATTATTTTATTGCTTGTTCTTTGTAGCCCAAATAC
TTTTATGGTAAAATGCTCACCATAATTTTGCAGTAAATATCCGATTACCTCATTGTTTCTCTATTCCACTTAGCT
ACAATATAGCTTCATTGTCTGGTGTACATTCAAACAAATTAAAACCTGTTTTTTCACTCCTAATTGAGGAGTGAA
AAAGACAAGGAAGCCCATATAGTTAATTTTCTTTAATGTTGACAGCAACCTCAACCACCCTCATAATAGATTTCA
TGTTTATTCCTCAAACTTATACTTCTTGCATAGTTCTATTAATGTGTATGATTACAATGAAATGTTTTGAAACCA
TCTTTTTAGTGTGAGATTTATGATGCATCATTTGAGATTTAATTATATTTGCGATCGAGAATTATATTAGTCTAC
TTCTCATAATACATTTACTAAATCCCTTTTGTTACTTGGTGTGAATGGAGCCATTGAACCATGTGAATTTATGCA
GCTCCTTATTGTCTTTCTTTTTAATATTTCTGTAATGTACTTGTGTATTTACAACCTTTAAGTATATTTCAGCAT
TAGCTAATTTTTTAAGTAGCATTTTCGCTTTTGTATCAATTTTCTTTTTAACAGAGGTCATAATTGTTGTGCTTC
ATTCAAGTTGATCACCAATATCACTGTAGGGTATCAATTCTATTGTTGGTCCTAAAACTGCTAGGAATATCGTTG
TCTGACCTGAGCTTGATTTTTGTTTCTTTTACTAATTATTTGTGTCTTTTTAGTAAACATGACACATGTTTATTA
TGTTTTTGTTCATATGTCACCAATACAGCTGTAGTGCATCAAATCAGTTTACACTTACAGTAGTTCTCTTCATTT
TTGTTCTGATACTGCAGTTTCCGTTGTTGAAGCAAAGAAATAACTAATAAGACAAAGCAAGACAGATGAGTGCAA
TAGTTCTAAAAATTACTGCACATGATTTTCTAAAAAATGAAGCATTCACATTACAACATTTATTTCCTACTGTAA
GTTAACTCCATAAATAGAAAGCTGCAAGTTTCAGGCATAAATTGTGAAGGGAAAATAGCTTGCTTTTCCATGGAA
ACAAGGTTCATATCTTCTTCCATTTCACATGGTTATGATTCAAATTGTTTCCTTTAGTAGTTTTGCATGTGCAAG
TCTGTGCTTGGTGGTTGTGTTTCTCCAATTCCTGCTCAAAGTAATTGTTTGTTATAAATTTATTATAAAATTAAT
GTGGAAATTCATGAGGTTTATATGTTGATAGCTTCATGAGAAAGACTACGGATGAGTGAGAGACTTGTACACTTG
TGCAAATTTGTTCATTTATGCAAACTTCATGTCATTAATTGTCAAAGCGTTTTCCATTCTGGTATGTGTAAAACA
TGATATAATTGAAATAAAAATCTACATTACCATCAAAGCAAAATTCTTTAAACAAGCATTCCAAACGAGAATTAA
AAAAAAAATACTGAAATATGACCAGTCAATGAGGTCACAAGACTAACATAAGCTTGGCGTGAATAGTTGCTGAGG

FIG. 24C

ATTCTCAATATGCGAGGCATTTGGAAGCACCAAAATCGGCACCCTACCGAGTACCCAAATCAAACACTTTCCATG
GTGCCTTTCCACTATCTTCCTCACAATGTAATCTTCTAGTGAAATAAATGCAGTTACCTCTGTTGAGACAGTGGA
TAGCCTTCTCATCAAAGAGCTAGCAGTGTTCACCTACCCCCGTGCTACAATGTTCACCTACCCCCTGCTACAGTG
TTCACCTGTCCCAAATAGTGTTCACCTGCCCCCATGAGAAAATTTATAAATATCCCCCTAAGTTTGATTTGTAAG
GTATCTCAGTAGCAGAGAGAGAAAGAGAAAGATACAGATATAAGTGATATCATTGAGAGGTCTTGAGAGAGAGTT
TGTAAGAATTCTTGGAGAGTGTATTGAACAAGAGAGGGTGTTCTCTTTTATCTTTATTTTTGTAACCTCGAAAGG
AATATAAAGGAATTGGGCGTCGTCGTTGCACCGTGGAGTAGCTCCGTAAGAGTGAACCACGTTATATCTGTGAGT
ACTGTGATTGAATTCGTGTTTATTGGTTCTATTATGTGATTCTAAGATCGTTTGGGTGTGTTTTGCGTCTCCATT
TGAGGCTTTCTTGTTAGGGTGTACCCTAACAAGTGGTATCAGAGCATACGGTTTGGGAAAGACGGAATCTTTTGC
TATGGGATCTACAGTTGAAGATAACATACTTCGGATTGAAAAGTTCGGCGGCCAAAATTTTAGGTATTAGAGGAT
GCAGATGAAAGACTATTTGTACCAAAAGGATCTCTTCATACCCCTCCAAGTAGAGGCGGGGAAACCTGAGAAGAT
GGACGATGATAAGTGGAAGGTGCTCGATCGTAAAGCACTTGCTGTTAGTTCTCTTGTTTTGATGATGATTTACAA
ACATCATTATTGGTGCTAATTGCTTGTTGAGTTATATTGTGTAGATTATAATTTATCAAGCAAGTTAGTGTTAAT
GTTGGAGGATTGGATGGAATCAAGCTGAACGATGATATCCATGGAGGTGGAGGAAATGTGTTGAAGCAAAGCTTT
CAAGAGCACAATACATAAGAGAAGCTTCATCAAAATATGAGCAAATATCAAGACCAAAGAATTGTATTCATATAG
ATATTTGCATCTTTCTCTTTCTCTCAAGTGCTTGATGTAGACAAGTTATTGAGTTGATAACATTTGAAGCTCATT
GGGTTCAACATACATTTTCACAAAAACATTGTTTTTGAACTATTTTGAAAAATGAGCAGTTTTACTATTGGAAAA
TGATCTTTCAGAAATTCTTGTTCTAACATGTTCAAAATCATGTTTATAAGCATTTTCTAAAGTTTTATAATTTTT
GGAATTTATTTGATATTTTATTTTGATTTTACAAAGTCAGATTTTCAACTAACATTAAATTCCTGTATGTACATG
TTTTCGGTCGACCGGGCTTTGCCCGTCGGTCGACCAACTAGAGAAGCTGTTTTCATGACCCTGCAAATAGTCACT
TGCGGTCAACCGATTTACATTGCGCGGTCGATCGATGACTAAGGGTCAGTCAACCGGAACATCATTGTCGGTCGA
CCGAACCAGTTCCAGATTGCTGAGTCTGCAACGGTCAAATATTCAGTCGACCGGACATTATCCATCGATCGACCG
GATCTTCTATAATGGCTAGTTTTTGTACCAGTTGATTTTCAGGATTTTGGTACTTGTTTGGAATTTGGCTATTG
TTTGGGGTTCCTATATATACCCCATTGCTCTCTTCACTTCAGTAATGATTTTAGCAAGAGAAAAATCTTAAGTTT
AGTTTTCTAAGTGTTCTTAAGCTCAAACTTTCAATTCTTAATCCTCAATTGTGTTTAATCCTTTGTTTTTCTCAC
ATCCACACTCCACAACCCTTGAGCTTTACTTGTTCTTCACTTGATCCTTGTCATAGGATTGTTGTGAGAGTTTTT
CATTCTTTCATTGTGATTGTGTGGTGAGATTGATCTCGAGGAGATCACTCGTGTGGATTGTAAAATCTTAAAAGG
AGATCATTGTGAAGAAGTTCCGGCTTTCAAACCGGGTGTGATAGTAAAGTTACCATCGGGAGAGGTGGTCGGGAC
GTAGGTCGGAGGATCGAACCTCGTGAACTTATCGTGTGTCACTATTGGATAACTATTCTCTAAACTCTTTCTTTA
TTTATTGCCTTTGCATTTAATTTGGTTGGTGTGTTACATTGACAAATTTTAATTGCACATTTATTGTCACATTAC
CCTATTCACCCCCTTAAGGTAATTTCAATTGGTATCAGAGCAAGGTCTCTACATATTTATTAGGTCTAACACCTT
AGAGAAAAGATCCAAATGGATTCTACAATGAATGTGCATATGCTTGAAGGTCAATCCACCACTATACCCTCTTTG
TTCACCGACAATAATTTTGCATATTGGAAAGCTAGGATGAGAATTTACTTACGATGCATTGAACTTGACATCCTA
GAAATAATAGAGAACAAATATGTTGAGAAGTCTAGTAAAGATATGACCAAGCATGAAAGGCATTTGGCTAACCTA
AATGTTAAAACCATGAAGGCTTTGATTTGTGGTCTCACCCCAAATGAGTACAATAGGGTCTCCATATGTGCAATC
GCACATAAGATTTGGGAGAAACTATGTGTTACTCATGAAGGAACCCCCAAGTCAAAGAGTTCAAAATTAGTAGCC
TCATGCATGATTATGAGTTATTTAAGATGCTTCCTAATGAGTCAATTGATGCCATGTTTTCTCGATTTACTAACA
TTGTTAATGAATTGCATGGCCTTGACAAGGTGTTGGAGAACCAAGAGAAGAATTATAAAATTCTTTACTCTTTAA
CGCCGGCATGGGAGCCTAAAACTACGGCTATGGAGGAAGTCAATGATCTCAGAACATTTACACTTGATGGTCTCA
TTGGCAAGCTCAAGGTCTATGAGAAGAAGATCAAGGAGAAGGAGGAAGTGCCCCTCTCGAGCAAATGAAGAGCCTT
CCCAAAAGATGAAAACAATTACGCTCAAAGGAGCAATTGATGATTCCTCCTCCTCGGATAGTGAAGTAGATGTCT
CTAAAGAAGTGGCACACCTCTCTAGAAGGATATCAAGATTAATAAAGATGAATAAAATTTTTAAAAATCATTCTA
ACAAGTTCCCCTCTCGTGTAGGTAAATGTTTTGAGTGCAATAAACCGGGACACATAGCAAAGGATTGTCCCAAGA
TAAAGAGAAGTACATGAAGTACAAAAAGAAGAAGGCAATGTATGCGGGATGGGAGAAATCGGAACCAAGCGACT
CGGATAGTGACGAAGAAGCCTGATAATCACATTTTATTACAATTTTATACCCTTATTATCTATTTTATATGAATA
AATATGCCATTAATAATTGTTTTTATCTTTAATTGCAGGTTAGTAAAGAATAAAACCCAAGATCTCTTATCTTAA
CAAAAACCCATAAATTAAATGAAGAACACAAGCAAGAGTCAAAAAGCCCAAGCCCAGAATCAAGCCGAGTAGCCT
GTAGAAGCCGGAGAAAATAAAAAAATTAAATATGAAAAAAATATATTCAAGATAGTTGGCCGTAAAGAAACGACG
ATATCTTCCAATCCGAAAGGCAAAATTTAACATATAATATATGAAAATCGCCTATCTCGACGAGACCAAGCTAAC
CGTAAAGTCAAAATTTTTATTGGAGCATCGATGCCAGTATCGATGCGGGCATCGATGCCTGTATCGATGCGAAGT
CATCCAGATTTCATCAACGGCCGAAATTGCATTCTTGGGGCTCAAGTTTGATCCAAGGGCTCTCATTCACTGATG
TTTACTATAAATAGGGGTTGAGAGTGAGGGGTTAGAGGTGTGAAAATTTTTGTAACTCTTTTTGGAGAGGAGGGC
TACTTTTAATTGAGAAGGCCTTCCAAATTTATAACTTTTTATTACAATTAATAAAATAATTTTTTTTACCACTGT
AAATTTTTCTCTTCTTCTCTTTGTTGGATGATGAAGATGAAGATGAAGATGGAGATTAATTTGAAGGTATGTTTT
TCTTATTTCTCTTTAATTGCTTATTAGTTTAGATTTATTTTCATGCTTGCAAATAGATTTTATTTTCTTGTTTAA
ATAGCCAAGAGGCTAGAACCCTCTTGCCTTAGATTTATTTCATGCTTATAGATTAGATTTATTTCATGCTTATAG
AGTAGATTTATTTTTTTTTGCATTTAATTCTTGTAATTTATTTTGTAGTTTAGATTTTGTAATTTATTTTGTAGTT
AGATTTTAATTTTTTATACTATTCACCTTGAGGCTAGAACCCTCTTGGATTTAGTTTTTCTTTTTATTCATTTTT
ATTTTTTTTATTTGCCTTTAGGCTAGAACCCTCTAGGGAATCATATTTTTCTAAGAAGTGGATTCAATTCTAGGT
TACCCATATCTTTAATTGAATCCGCTATCTTTACATTCTTGATTTTTATTTGTTCTTGATTTTTCCTTCTTGCCT
TGTTGATCACATTTACATTATCACTTCCACTCTCAAATATATTCATTTACATAATCATTTTCATCTTTCCACAAT

FIG. 24D

CACATTCACTTATCACTCCTATTTGTCACGCACACAACATAAGAACCGATTTTATATTTTCTCCTACAAAACACC
TTCCTCGTGGATCGATATCTTTATACTATAACTTGACACGGTTGTGCACTTGCAACATTTTTGGTACATATTTAT
GCCGCATCAAGTTTTTGACGTCATTGCCGGGGAAGGTGCTTAAGTATGTTTTAATTATTTTGGTTCTTTAACTTG
TGTGTTTATTGTGAAGGAAACGCTTGAAGCTTGAAGATCGCGGATTGGAGAACTAGGATTTGAAGATTTGCTTGT
AGGTAATTCTTCTTTTTAGAATTTTTAATTCCACCCTTTAGCTACTTCTTCACAATTAGAGACAATTAGGACTTA
AAAAAAGAGATTTTATTTTTGTTGACCATAATAAAATTCACCCTCCACTTTGACATTTACTAACAAGATAATAAA
TTCAAATAATATCCCCCTTCTCATTTGTTTAATTGTTAACCCTAATTAAAAAAAAAGGTTTTTTCTTTTCCATCC
TTTTTAGTTGCTTTTAATTCATTGGGTTTCATTTCATATTGTTAGTAGGAATTCACCAAGTGATTTGAGCATCTT
GATTTGGCACACACTTAAAAATATTTTTAAGGGTAAAACCTAATATTCAAGATAATGTGAGAGATTTCATCACCC
TTCCCTTAGCCTAAAAATCACTAATTCCTCACTACACCACCCAAGCCTAATAAAACTCATTAGACGTTGGCCCCT
AAGGATTCGAGCTCAATAAGGAACAAGAAATCCTTAAGTGAACCGGTTTAAGTTTTCTCAGAATAGTTGGTGTCT
AAGGCAAGGTTTAGGGGTTGCGTAAAGCGCTCCGCAAGGAAAGAGGTACTTAATTGATCTTTGATCACCCTCTAG
TACTATCCTTACCTGGCTAACTACCCGGGTAAAACTTTAATCTTTTCACTTTAGGAGTTTTTGGTTAGGAGGTAG
TCTAGTTGAGTTAAGCTTAACCCTAGAGTTAGAGTGATTGGAAAGTGATTGATTTTGATTTGTTTAGTTAGGATT
TTTTTCTCTTTTTCCATTCTCTCCTCATTAAAAAAAACTAACCTTTATAATAATAAAAAAAGTATAAAAAGAAAT
AGTTTTGGTGTATGCAACCGTGGATTAGGGATAATACACATCGATTAATTCGCTTTGAACCAATCATAGAAATAG
CGTATCCTAATCCACCCGTTCTTCAAGATATGTGCTATCCCATTAGGAATGCAATCCCCTCTTGTATTAGGCTCC
CCGAAACAAATGGAATAAATTTTGAGCTTAGAGCGTATTACATAAATATGCTTCCCAAATTCCTTGGAAATGAAA
CAGAAGATGCATATATTTTTATCTTGGAATTTGAGGAAGTGTGTATTATGATTAAAATGAGAGAATTAACAGAAG
ATGCGATCAAACTCAGATTTATTCCATTTGCTCTTAAAGACAAAGTAAAAAAATGGTTGTATAGCTTACCCGTAA
ATTCCATCACTACTTGGGAGGAATTTATCACCGTTTTTCTTAAAAAAAAAAATTCCTATCCATAAAACGATAAAG
CTAAGAAACAGCATCATGAATTTTAAAATTATCCTAGGAGAACCTTTTTTGCAAGTATTTTGACCGATTTAAAGAT
CTTCTCATCTAATGTCCTCATCACGGTTTAGAAAAATGGTGATTGTGCCAAATAATTTATGAGGGATTAGATTAT
TCTACAAAAACTTCCTTAGAATCAATGTGCCATGGGGATTTTATGAGGAAAAATACCGATGAAGCTTGGGAATTT
CTAGAGAGTCTATCCGAGAAAACAATGCAATGGGAACACTGTGATAACATGGTTTTATCAGTTCCCCATTCTAAG
TCTAATGGTCTTTCCTTGGAGTCAAACATTACTTCTGAAGC

>SEQ ID NO:4; Dominant male stimulator, Stimulator of androecium, development, AsOfTDF1; predicted cDNA homologous to Defective in Tapetal Development and Function 1 of Arabidopsis AT3G28470) and Oryza sativa osTDF1 (LOC_Os03g18480)

ATGGGCAGGCCTCCATGCTGCGATAAATCCAACGTGAAGAAGGGACTTTGGACTGAGGAAGAAGATTTGAAGCTA
ATAGCTTATACCAACACTCATGGAATAGGAAATTGGACTTCTGTTCCAAAGAAAGCAGGGTTGAAGAGATGTGGG
AAGAGCTGTAGGCTAAGATGGACTAATTATCTGCGCCCTAATTTGAAGCATGAGAGCTTCACTCAACAAGAAGAG
GAGATGATTATAACACTTCATGCTACAATCGGAAGCCGGTGGTCGGTAATCGCACATCACCTCCCGGGTCGAACA
GACAACGACATAAAGAACCACTGGAACACAAAACTGAGCAAAAAACTGTGCCAGCAAGGCATCGACCCCGTCACC
CACAAACCCATCTCTCAAATCAAGGAAACCATCACCACTCTAGCCGCCGCCGCCGCCGCCAACCACCACCTCCTA
ATCCACCCTCCACCCTTCAACACCCCGCGTCAACAGCTGCCTGAGCCGCGACCTCAAGAACGTCCTCCTCTCCAAA
CCGCAACAATTCTACGAACCAACAACAGCCACAAGCACCACATTGGATGAGGTTTATAAGCAGGATAAGGAGATC
AAATGGAGCGATTATCTCGTCGACGATGTTTTCGTGCCGAACCAAGAGAAGGAATTGGTGGTGAATGGATATGGG
AAGGAGAAGGTGACAAGTGCAGTGGATGAGGAGGTGAGTAGTACTGTGTTTGGAGGTGAAGGGAGTAGTAGCTCG
AGTTCTTTTGTGGAGGGAATATTAGATCAGGGGAGGGAGATGATGATGGAGTTCCCTGAGTTTTTTTATGATTTG
CTGTAG

>SEQ ID NO:5; Dominant male stimulator, Stimulator of androecium development, AS-TDF1 Predicted protein MGRPPCCDKSNVKKGLWTEEEDLKLIAYTNTHGIGNWTSVPKKAGLKRCGKSCRLRWTNYLRPNLKHESFTQQEE
EMIITLHATIGSRWSVIAHHLPGRTDNDIKNHWNTKLSKKLCQQGIDPVTHKPISQIKETITTLAAAAAANHHLL
IHPPPFNTPRVNSCLSRDLKNVLLSKPQQFYEPTTATSTTLDEVYKQDKEIKWSDYLVDDVFVPNQEKELVVNGYG
KEKVTSAVDEEVSSTVFGGEGSSSSSSFVEGILDQGREMMMEFPEFFYDLL

FIG. 24E

>SEQ ID NO:6; Stimulator of androecium development, AS-TDF1 genome region

[illegible]

SEX DETERMINATION GENES AND THEIR USE IN BREEDING

CROSS-REFERENCE TO RELATED APPLICATIONS

This application is the national phase of PCT application PCT/IB2016/000031 having an international filing date of 10 Jan. 2016, which claims benefit of Dutch patent application No. 2014107 filed 9 Jan. 2015. The contents of the above patent applications are incorporated by reference herein in their entirety.

SUBMISSION OF SEQUENCE LISTING ON ASCII TEXT FILE

The content of the following submission on ASCII text file is incorporated herein by reference in its entirety: a computer readable form (CRF) of the Sequence Listing (file name: 313632021800SeqList.txt, date recorded: Jun. 2, 2020, size: 945,059 bytes).

FIELD OF THE INVENTION

The present invention relates to the field of plant breeding, in particular breeding of dioecious plants, in particular asparagus. The invention extents to the field of both classical and molecular plant genetics and relates to sequences of a novel DUF247 motif containing gene and its mutants and their use in marker assisted breeding, targeted mutagenesis, or in transgenic plants, e.g. to produce feminized or de-feminized plants. It further relates to sequences of the asparagus gene homologous to the *Arabidopsis* TDF1 gene (AT3G28470) or the *Oryza sativa* osTDF gene (LOC_Os03g18480), and their use in marker assisted breeding, or in transgenic plants, e.g. to produce masculinized or de-masculinized plants.

BACKGROUND OF THE INVENTION

Plant breeding is one of the oldest accomplishments of mankind. It began when he domesticated plants by growing them under controlled conditions and selecting those types that provided a dependable source of food. No product of the plant breeder's art or science has had greater impact on increasing the world's feed or food resources than hybrid varieties. Dramatically successful at first in corn, their use has spread to other crops, including both cross- and self-pollinated species. Hybrid varieties are those in which F1 populations are used as the commercial crop. Parents of the F1 may be inbred lines, clonal varieties or other populations. Hybrid varieties are used where the increased yield from hybrid will be more than from the extra costs associated with their development and the extra costs of their seed production price. An added premium in the case of hybrids of inbred lines is uniformity. Methods for developing hybrid varieties are provided in the book "Introduction to Plant Breeding" by FN Briggs and PF Knowles (1967) (supra p 223.239).

Plant breeding has the objective to produce improved crop varieties based on the exploitation of genetic variation, which exists within the germplasm of a plant species. Genetic variation is traditionally obtained by crossing two genetically distinct plants to create hybrid progeny. In the process of developing hybrid varieties, hybridization is not aimed at producing a pure-breeding population but rather to produce F1 hybrid plants as the final cultivar.

The F1 hybrid of crosses between different genotypes is often much more vigorous than its parents. This hybrid vigour, or heterosis, can be manifested in many ways, including increased rate of growth, greater uniformity, earlier flowering, and increased yield, the last being of greatest importance in agriculture The production of hybrid varieties commonly involves three steps: (1) the selection of superior plants; (2) inbreeding for several generations to produce a series of inbred lines, which although different from each other are each pure-breeding and highly uniform; and (3) crossing selected inbred lines. During the inbreeding process the vigour of the lines decreases drastically compared to that of field-pollinated varieties. Vigour is restored, however, when any two unrelated inbred lines are crossed, and in some cases the F1 hybrids between inbred lines are superior to open-pollinated varieties. An important consequence of the homozygosity of the inbred lines is that the hybrid between any two inbreds will always be the same. Once the inbreds that give the best hybrids have been identified, any desired amount of hybrid seed can be produced.

As outlined above, an essential step in creating a hybrid cultivar is to obtain inbred lines. In non-dioecious crops, a common way to obtain these homozygous plants is to apply self-pollination and self-fertilization for several generations (inbreeding). Alternatively, the process of inbreeding by several generations of self-fertilization can be replaced by creating plants exclusively derived from gametes, either egg cells (gynogenesis) or from pollen (androgenesis). When the genetic content of plants derived from gametes is doubled, either by chemical means (such as by using colchicine) or by spontaneous chromosome doubling, fully homozygous plants are obtained. Such plants are called doubled haploids. In non-dioecious crops such as pepper, eggplant, cucumber, maize, rapeseed, broccoli etc. —doubled haploids can be multiplied by seed propagation, simply by self-fertilizing such plants. This allows fast multiplication of parental lines which is highly desirable when used as parental plants in large scale hybrid seed production. Another advantage of seed propagation of doubled haploids is that it allows convenient storage, as seeds can be stored for a relatively long time under controlled climate conditions in relatively small compartments. Compared to storage of living plants, that require land or greenhouse space, and that are prone to adverse environmental conditions, pathogen attack, and somatic mutations, seed storage is relatively safe at low costs. Furthermore, seed propagation can be used to get rid of certain (non-seed transmittable) pathogens. In addition, seed propagation may improve plant growth of ex-vitro plants which may grow sub-optimal as a result of the long lasting effect of hormones applied during tissue culture (Smulders & de Klerk, 2011) in a way it could restore the lowered DNA methylation that resulted from tissue culture (Machczynska et al., 2014) although some methylation changes may be heritable (e.g. see Stelplug et al, 2014). In this sense, seed propagation could positively change the physiological state of explants. Clearly, the ability to reproduce doubled haploids by seed propagation offers several advantages. In the production of doubled haploids in the dioecious crop *Asparagus*, anther culture (Qiao & Falavigna 1990) or microspore culture (Peng & Wolyn, 1999) is applied and there are no reports of successful in vitro gynogenesis in *Asparagus*. As a consequence of this, in vitro haploid production is restricted to male plants, thus those plants that are capable of producing functional anthers. The inability to self-fertilize and/or to apply in vitro androgenesis hampers the improvement of seed parents of commercial hybrids in case those seeds parents showed a good combining ability in early generation hybrid testing (for early testing see: Longin et al., 2007). This contrasts to the situation in non-dioecious crops such as corn, pepper, eggplant, *brassica* etc. where a seed parent of a hybrid cultivar can be directly improved, either by further inbreeding or haploid production using a single plant as starting point. In conclusion, inbreeding and/or seed multiplication by self-pollination and in nitro androgenesis is fully obstructed for female asparagus plants. Direct in vitro androgenesis cannot be applied to female plants such as the seed parents of asparagus hybrids.

Besides inbreeding or doubled haploid production as a tool to create elite hybrid parental lines, breeders can use other techniques. One such technique is referred to as back-cross breeding or recurrent back-crossing. In back-crossing a donor parent, which has one or more genes of interest, is crossed to a recurrent parent which is an elite line that could be improved by adding such one or more genes of interest. The progeny of this cross is selected for the trait of interest and then crossed back to the recurrent parent. This process is repeated for as many back crosses as are needed to create a line that is genetically similar (syngeneic) to the recurrent parent, except—of course—for the gene(s) of interest. The goal of backcrossing is to obtain a line as identical as possible to the recurrent parent with the addition of the gene(s) of interest that has been added through this breeding process. Recurrent back-crossing or back cross breeding is an efficient way to improve the quality of parental lines that are known to combine well as parents of hybrids but hitherto lacked certain traits to make these even more perfect parental lines. In non-dioecious crops it is irrelevant whether a trait needs to be introduced in a breeding line that will finally serve as the female parent or the male parent of a hybrid. However, in a dioecious crop, such as asparagus, a first cross to introduce a trait found in a female donor plant into the seed parent of a hybrid is impossible as females cannot be crossed with females. Likewise, most male plants (andromonoecious plants excepted) cannot be intercrossed in a dioecious crop, such asparagus, therefore a first cross to start a backcross program to introduce a trait from a male plant into another male is not, possible. Further below it, will be explained that back-crossing to introduce a trait in the male parent of an all-male hybrid is problematic, even in the case that the donor of the trait is a female plant, for a dioecious crop such as asparagus.

Generally, the breeding tools outlined above, such as the [1] ability to apply self-fertilization, [2] the ability to apply successive backcrossing, [3] the ability to apply seed propagation and/or seed storage of doubled haploids or inbred lines or [4] the ability to further improve the seed parents of an early generation hybrid by in vitro androgenesis can be used in many non-dioecious crop species (e.g. corn, pepper, rapeseed, cabbage, cauliflower, broccoli sunflower, barley, cucumber, eggplant). However, the dioecious, rather than hermaphrodite nature of *Asparagus officinalis*, limits the use of self-fertilization, back-crossing, and seed propagation of doubled haploids and in vitro androgenesis of hybrid seed parents in asparagus breeding. There is thus need to provide methods to, at least partly, overcome the limitations caused by dioecy on breeding and seed production of asparagus. To appreciate this, one should he aware of all aspects on the inheritance of gender in *Asparagus officinalis* and the use of so called 'super males' to create all-male asparagus hybrids. This will be further explained below. Before describing the inheritance of gender traits first some definitions are made that will allow the reader to better understand the text below.

A female asparagus plant is a plant that produces only flowers that have fully developed female organs, such as a style and stigma that allows fruit set and only produces white rudimentary anthers. A male asparagus plant is capable of producing flowers with fully developed anthers. If a male plant is capable of producing berries it is either andromonoecious or hermaphrodite. Andromonoecious plants bear both male flowers that only have rudimentary female organs and hermaphrodite 'perfect' flowers, whereas hermaphrodite plants exclusively produce hermaphrodite flowers. One would expect that a highly andromonoecious plant but at least a true hermaphrodite plant will produce berries from virtually every flower. However, as will be further discussed below, this is not always true for plants typed as hermaphrodite (Thevenin, 1967) or not recorded for highly andromonoecious plants (Wricke, 1968, Wricke, 1973) which is rather confusing.

*Asparagus officinalis* is a dioecious species with separate unisexual individuals producing male or female flowers. Male and female flowers at early stages of development possess both carpels and stamens; sex differentiation appears to be the result of the selective abortion of carpels in male flowers and of stamens in female flowers. The abortion pattern is, however, different in the two sexes: in female flowers, stamens stop developing and collapse while, in male flowers, the ovary remains blocked in its growth without degenerating after stamens have taken over (Lazarte and Palsen. 1979, Caporali et al., 1994).

The genetic control of sex determination in this plant is based on a model in which regulatory genes control the expression of structural genes involved in stamen and carpel development present in both sexes. Two regulatory genes of the type "male activator" and "female suppressor" as proposed by Westergaard (1958) in *Silene*, have been suggested to be operating in *A. officinalis*. One of the first authors who raised the model of Westergaard as a model for sex determination in asparagus was Wricke (1968). In the introduction of his publication the author describes female and male asparagus plants that are homogamous XX and heterogamous XY, respectively and further notes the possibility to obtain homogamous YY male plants by self-fertilization (also proposed by Rick & Hanna 1948, and Sneep 1953). This self-fertilization is possible as a small fraction of male plants is able to produce hermaphrodite flowers. YY male plants, also referred to as 'super-males' allow the production of entirely female free cultivars, also referred to as 'all-male hybrids', when those plants are crossed to female plants. An all-male cultivar is particularly valuable if plants belonging to this cultivar produce no berries at all and this poses a conflict. When the ability to produce YY males by self-fertilization of a plant that produces hermaphrodite flowers is heritable, it is likely that this trait will be transferred to the hybrid, which is undesirable. The question to which extent the relative amount to produce hermaphrodite flowers is heritable was raised earlier by Beeskow (cited in Wricke, 1968) who classified flowers, that all have anthers, into types denoted by the roman numbers I, II, III, and IV to describe the stages of a flower that has no style or stigma at all (I) up to a flower that has a fully developed style and stigma: (IV). Wricke (1968) explains that the material he studied could be divided into two groups, in which one group predominantly produces flowers of type IV (and never flowers of type 1), whereas the other group predominantly produces flowers of type I (and never flowers of type IV). Based on the fact that some males crossed to a particular female result in progeny that predominantly produce type IV flowers whereas other males crossed to the same females result in progeny that predominantly produce type I flower (see his Table 1) Wricke, (1968) concluded that a major factor on the Y chromosome confers the 'andromonoecy-degree'. This interpretation is subject to debate. Although his data indeed show that the level of andromonoecy seems to depend on the particular paternal plants chosen, these results do not reject that this may result from mere chance (thus not necessarily depends on the parental, rather than any parent) as only a limited set of female plants has been used (six maternal plants versus twenty different paternal plants).

Wricke tackles the controversial interpretation of the results shown in his Table 1 (published in 1968) by presenting a new Table 1 in a following publication (Wricke, 1973) in which he shows the result of second generation pedigrees of crosses between females and males that either were members of pedigrees showing high or low levels of andromonoecy in their previous pedigree. Indeed results obtained from those pedigrees presented in Wricke (1973) suggest that factors conferring andromonoecy must reside on the Y chromosome. In his publication of 1968, Wricke, regularly (as also shown in the subtitle of his paper 'Ein Majorfaktor für die Ausprägung des Adromonoöziegrades') mentions a major factor on the Y chromosome which confers andromonoecy and he seeks evidence for this hypothesis by a detailed discussion of results obtained from the highly andromonoecious plant '143/4a/5'. This plant (that itself shows flowers of type III and type IV) was crossed to three mother plants. In those crosses, andromonoecious plants (type IV) and female plants were obtained. When plants, within the progeny that did not flower were interpreted as females (which usually show delayed flowering) this corresponded to a 1:1 ratio for plants that segregate for the absence or presence of anthers but breed true for a well-developed style and stigma. Plant 143/4a/5 was further crossed to three father plants that were all hypothesized to have a low level of andromonoecy. The resulting progenies (designated 4, 5, and 6) lacked females and comprised both male (class I) and andromonoecious plants (class VI). Wricke (1968) interprets these result as the gene action in which a '$Y_I$ chromosome dominates over the $Y_{IV}$ chromosome' consistent with a dominant female suppressor, proposed for *Silene* (formerly *Melandrium*) by Westergaard (1958) who is cited in his paper. However. Wricke's (1968) results obtained for progenies 5 and 6, hypothesized to be $XY_{IV} \times Y_I Y_I$, in fact are inconsistent with this model; plenty of andromonoecious plants were observed which, theoretically cannot exist because of the assumed dominance of the homozygous father ($Y_I Y_I$). The self-fertility of Wricke's material remains obscure as he does not describe the level of berry set and subsequent seed production in both of his publications. In Wricke. (1973) it is even explicitly mentioned that fruit set has not been recorded. Another limitation of the work of Wricke (1973) is that he only describes the average level of andromonoecy in his Table 1 and does not supply the segregation ratios for andromonoecy within those pedigrees. In conclusion, the work of Wricke (1968, 1973) provides insufficient teaching on the exact mode of inheritance of andromonoecy and the presented data does not (fully) support his conclusions.

A second study in which the model of Westergaard (1958) is raised as a model for sex determination in *Asparagus* is the work of Thevenin (1967). This author describes three flower types. Type 1 represents a female flower with a well-developed pistil, a tri-lobular stigma and white rudimentary anthers. Type 2 represents hermaphrodites that have a pistil comparable to that of female flowers and six yellow stamens at all points comparable with those of males. Type 3 represents flowers of a male type or flowers that have an intermediate phenotype and have a more or less reduced pistil (an ovary of reduced size, a reduced style or even no style (zero), stigmas that have one or two lobes and a reduced number of papilla or none). She further states that plants that hear female flowers hear no other types, which also holds for plant bearing flowers of Type 2. In conclusion, Thevenin (1967), describes plants for which every flower can be perfect. However, it is noted that the production of berries and seeds does not depend fully on flower morphology except for flowers of Type 1. In the work of Thevenin it is explained that usually, plants that only bear Type 2 flowers produce a number of berries that may vary from zero to one up to several thousands although the latter number is exceptional. It is important to note that it remains obscure from the work of Thevenin (1967) whether she ever found a hermaphrodite (as inferred from the flowering) that sets fruit from each flower. The hermaphrodites described produce small berries that usually contain only single seeds. Thevenin (1967) points out that hermaphrodites usually produce at least some seeds that have an imperfect (white) seed-skin as opposed to black perfect seed skin that is commonly found in female plants By allowing uncontrolled as well as controlled self-fertilization, Thevenin (1967) obtained progenies for plants that were either classified as Type 2 or Type 3 (based on the flowers observed on those plants). Each of those progenies segregated for female, male and bi-sexual plants. The fact that both male and bisexual plants are found in this progeny poses a problem. Like Wricke (1968), also Thevenin adopts the model of Westergaard (1958). She hypothesized that these bi-sexual plants result from a crossing-over event that resulted in a pair of linked genes [M su] where 'M' denotes a gene involved in anther development, and 'su' a recessive allele of a dominant female suppressor Su that is commonly linked to M. If according to this model [M su/M su] plants are self-fertilized, theory excludes the presence of [M su/M su] males in the progeny, which however have been found in the study of Thevenin (1967). To explain this, Thevenin introduces a series of recessive genes 'r' that in homozygous condition negatively interfere with stigma development in plants that carry the dominant M allele, thus only in male plants.

The last person who describes the genetic mechanism for sex determination in asparagus as the result of two linked genes is Marks (1973). Although this author does not explicitly refer to Westergaard (1958) an equivalent model is presented in which a recessive gene 'g' controls the gynoecium and is closely linked with a dominant gene 'A' concerned with the androecium. Marks (1973) states that this model is more appropriate compared to other models 'as it requires no modification or very little to explain the results obtained with hermaphrodites and to state his case, he uses the data that were previously obtained by Peirce and Currence (1962). These latter authors describe hermaphrodite cultivated asparagus plants, which have perfect flowers and performed crossing experiments to unravel the inheritance of hermaphroditism. It was the conclusion of Peirce and Currence (1962) that hermaphroditism is controlled by several dominant linked genes located on the sex chromosome separated by a crossing over distance of 30 to 40 cM. Thus compared to the interpretation of Peirce and Currence (1962) who report of several dominant genes, the model of Marks (1973) who reports of a dominant gene for the androecium development combined with a linked recessive gene for gynoecium development is quite different. Although Marks' (1973) model fits for two pedigrees ('2-3' and '3-4') his model fails to explain the existence of males in two other pedigrees ('1-6' and '4-1'). These males are then explained by Marks (1973) 'as being genetically hermaphrodite as far as the gA locus is concerned but having in addition a recessive gene s which when homozygous suppresses the gynoecium; such plants then being phenotypically male'. In this sense, his model is polygenic just like the model of Thevenin (1967). The inconsistencies between the theoretical ratios and the observations in the second generation $F_2$ and $BC_1$ pedigrees stemming from pedigree '2-1' are explained in Marks (1973) as the result of distorted segregation. Although he claims to provide a model that in his view 'requires no modification or very little to explain the results obtained with hermaphrodites' it is—like other models—still based on explanatory hypothesis such as a recessive modifier and distorted segregation that have not been tested further. Marks (1973) replies that more data would needed to a question of Thevenin in a discussion section guiding his paper (page 129) on how to verify his hypothesis. Personal communication with University of New Hampshire emeritus Professor Lincoln C. Peirce (e-mails 2010 and 2015) indicates that more unpublished data have been obtained, which indicate that the experimental evidence obtained for pedigree 2.3, notably further generations, have been less clear than would arise from the model suggested by Marks (1973). Lincoln C. Peirce has stated the following: 'After the original work was done and published, I continued to make crosses, hoping to learn more about the inheritance system. The more crosses or self-pollinations I made, the more inconsistencies I found, all from material derived from the original crosses or backcrosses'. And he further wrote: "2.3' was unique—I never found a plant like it in later crosses or selfs. That led me to conclude that there had to be other factors involved, but I never was able to pursue it.'

In a question to elaborate on the uniqueness of 2-3 Lincoln C. Peirce replied that he 'never found any lines just like 2.3' in a sense that 'there never was found any derived line that was as strongly hermaphroditic as 2-3 where every flower produced a berry yet had fully developed anthers'.

These unpublished results contrast with the model of Marks (1973) which—based on a recessive gene 'g' that controls the gynoecium that is closely linked with a dominant gene 'A' concerned with the androecium-predicts that plants as strong as 2.3 would be observed in later progenies.

In conclusion, in each study in which the model of Westergaard (1958), that describes a dominant female suppressor, is supposed to be acting in *Asparagus* (Lopez-Anido and Cointry 2008) the results do not fully comply with this model or to put it more strictly, the results would reject this model.

Earlier work before the model of Westergaard was published, originates from Sneep (Sneep, 1953a, 1953b). This author, who strongly advocated the use of andromonoecious plants to obtain super males as hybrid parents, acknowledged the importance to prevent andromonoecy in commercial seed and performed genetic analysis of the trait to possibly tackle this problem. One andromonoecious sibling in the progeny he describes, which spans three generations, breeds true for this trait whereas another andromonoecious sibling was able to produce purely male individuals, besides andromonoecious individuals. As a result Sneep (1958b) concludes that andromonoecy is controlled by dominant factors and that progeny size has been too small to predict the number of factors involved. As method to prevent andromonoecy he suggest to select plants that have recessive alleles for dominant genes controlling andromonoecy.

Another model that resembles, yet only partly overlaps, with the model of Westergaard (1958) is a model proposed by Franken (1970). This author studied several progenies of self-fertilized andromonoecious plants and concluded that a partial dominant gene (modifier, 'A' in his nomenclature) was responsible for the suppression of pistil development (see Table below); and that this gene was inherited independently of the male sterility allele located on the X chromosome.

Phenotypes (genders) and genotypes proposed by Franken (1970) as a model of inheritance of sex.

| Female | Male | Andromonoecious |
|---|---|---|
| XX AA | XY AA | XY Aa; weakly |
| XX Aa | YY AA | XY aa; strongly |
| XX aa | YY Aa | YY aa; medium |

The model proposed by Franken (1970 is in concordance with the results of Galli et al. (1993) who, after analyzing the length of pistils in some backcrosses, concluded that the factors affecting style length and stigma development (modifiers) are not localized on the sex chromosome. In the model of Galli et al (1993) the backcross distribution of style length fitted a model of at least two loci. Franken's model, presented in the table above principally is an additive genetic model of complementary gene action in which the Y chromosome gives rise to staminate flowers (anthers but no pistils) and recessive 'a' alleles alleviate the effect of the Y chromosome and allow some pistil development. The balance between the number of Y chromosomes that push flowers in the staminate direction (anthers but no pistil) and the number of recessive 'a' alleles, which allow a certain degree of pistil development, sets the level of perfect flowers that can be produced. Franken (1970) acknowledged that not all of his crossing results could be explained by a simple genetic model and careful study of the tabulated results in Franken's PhD thesis (see Table 37a and Table 37b in Franken, 1969, chapter 8 pp. 56-58) suggests that andromonoecy is a quantitative rather than a qualitative trait which can be influenced by the environment. To meet this quantitative aspect, especially to explain YYAa plants that sometimes tend to become more andromonoecious, Franken (1969, 1970) introduced G factors that positively contribute to stigma development in males. Thus like Sneep (1953b), also Franken (1969, 1970) describes dominant genes that may contribute to andromonoecy.

All of the above studies have demonstrated that principally, a male plant can be produced by self-fertilization of flowers on andromonoecious plants, which plants sometimes were referred to as hermaphrodite when all flowers were perfect. It was further explained that if a andromonoecious plant (XY) is self-fertilized, a quarter of the progeny will be YY; in asparagus breeding referred to as a super male. In case a super male is used as paternal parent to pollinate a female parent, hybrid progeny is obtained of which all plants are XY, thus are male in a way that all of these plants will produce anthers. However, whether or not those plants will be able to produce berries will rely on multiple factors such as 'Su/su' and 'r' (Thevenin, 1967), 'Y', 'Ala', and 'G' (Franken, 1969, 1970), 'several dominant factors' (Sneep, 1953a, 1953b, Peirce & Currence, 1961) and '$Su^F/su^F$'plus modifying genes that either moderately or strongly control stigma development' (Wricke, 1967. p209) and 'a recessive gene s which when homozygous suppresses the gynoecium' or a phenotype frequency that may be influenced by distorted segregation (Marks, 1973).

All these modifying genes or factors, of which some may designate the same gene or factor, are unknown. As already pointed out by Sneep, the andromonoecious trait used to create super-males must not end up in commercial seed. This poses a conflict: the parental lines of a hybrid cultivar can be created by self-fertilization mediated by heritable andromonoecy and the more this heritable trait is expressed, the more efficient the creation of lines will be. However, the hybrid that originates from a cross between such parental lines should not express the heritable trait. If the heritable trait is complex and unknown, the breeder is unable to exploit expression to create inbred parental lines of a hybrid on the one hand, and avoid expression on the other hand, when the parental lines are used to create a commercial hybrid.

As a result breeders preferably avoid obtaining YY plants by selfing andromonoecious plants but instead prefer to obtain these by anther culture of male plants. However, even in the case of using doubled haploids as parental plants, hybrids can be created that are andromonoecious when parental plants either from the maternal side or paternal side have piled up a sufficient number of modifiers that overcome the hypothesized masculinizing effect of the Y chromosome (as hypothesized by Franken, 1970). It should further be noted that if the breeder would like to apply inbreeding by using andromonoecious plants this work is limited by the fact that andromonoecy is restricted to a small subset of the genepool or germplasm as andromonoecy or hermaphroditism occurs in about 0.1 up to 2% of the breeding material (Thevenin, 1967, Sneep, 1958). In conclusion the breeder must avoid that modifiers end up in the hybrids and further the breeder is limited by the rare availability of sufficient andromonoecy throughout the breeding pool.

Whether or not super males have been obtained by self-fertilization using andromonoecy or anther culture, the super males created have certain shortcomings compared to male parents of hybrids of crops belonging to common self-pollinating species (such as tomato, pepper, eggplant, rapeseed, broccoli etc). Firstly, because genes that favorably modify the phenotype towards andromonoecy must be avoided (else hybrids would produce unwanted berries) which means that super males can never be seed propagated at large scale.

Secondly, and this is an important aspect, a super male cannot be improved by successive backcrossings as the F1 plant obtained in the first cross is a male that cannot be directly backcrossed to the super male in which a new trait should be introduced.

In case a breeder would like to make use of perfect flowers that allow self-fertilization, at least simple inheritance of the hermaphrodite trait would be desirable, preferably a monogenically inherited trait, which is easy to get rid of in one or just a few generations. Preferably, such a monogenic trait can be selected for by a genetic marker.

In conclusion, the art of asparagus breeding would strongly benefit from the availability of hermaphroditism that is simply inherited and thus is highly predictable and easily selected for or selected against in certain stages of breeding, preferably by a genetic marker.

Further the art of asparagus breeding would strongly benefit if a breeder could use a method that allows inbreeding by self-fertilization, and allows to seed-propagate inbred lines or to seed propagate doubled haploids. Finally, an asparagus breeder would like to be able to apply direct recurrent backcrossing on a super male plant as recurrent parent. A breeder would like to be able to perform all of the above without being bothered by introducing unknown modifiers, unlinked to the sex chromosome, that favor andromonoecy or being bothered by the limited number of plants that exhibit sufficient natural andromonoecy. Ideally, the change from a male plant into a hermaphrodite, or, more generally, methods to influence the sex of plants in a breeding scheme, to tackle all of the above problems, is targeted and acts temporarily.

In an even more ideal situation the female suppressor or suppressor of gynoecium development, that is hypothesized but never fully proven to exist or at least not proven to act monogenically is identified and can be manipulated in a sense of 'switching it on and off'.

Where a breeder could be interested in enabling or disabling gynoecium development this breeder—depending on the intended use of a plant as either seed or pollen parent or both—could also be interested in enabling androecium development. Enabling androecium development in a female plant to essentially change the gender, would allow to obtain seeds from an originally female plant in the absence of cross pollination (thus by self-fertilizaton) and would provide the ability to obtain doubled haploids by in vitro androgenesis from such a plant. This will allow inbreeding which may led to breeding lines that are more superior compared to the original female plant that was enabled to self-pollinate. It will allow seed storage of the female breeding line. The ability to tune and change the gender of female plants (originally lacking functional anthers) and male plants (originally fully or partly lacking gynoecium development) will allow flexibility in crossing schemes that are currently hampered by dioecy. The ability to tune and change the gender of male and female plants may also broaden the gene pool in creating hybrids when a male plant that appears to be a good general combiner in hybrid crosses could be changed into a female plant and then crossed to suitable male plants or when a female plant that appears to be a good general combiner in hybrid crosses it can be changed into a male plant and then can be crossed to female plants.

In the art, its has been suggested that such sex changes might occur (Maeda et al 2005) but the evidence thus far has been too weak to be absolutely sure this has happened, let alone to understand how this can be accomplished.

In a study published by Maeda et al (2005) it has been hypothesized that a female asparagus plant has been obtained from the male vitroclone cultivar Festo as the result of in vitro embryogenesis. It is written that a sex conversion has been 'identified' and that 'the sex conversion in the current study might be the result of the somatic mutation, such as somatic crossing-over, one of the chromosomal rearrangements'. This hypothesis of sex conversion is based on the genetic analysis of a single female plant found in an evaluation field that was compared to five male plants. Maeda et al (2005) have used allozymes that were previously used by Ozaki et al (2000a), where Ozaki has been the corresponding author for both studies. Ozaki et al (2000a) discussed the use of allozymes repeatedly in the light of detecting contamination. However, rather than testing plant contamination, Maeda et al (2005) discussed their results only in the light of multiple somatic recombination events and have projected the loss of heterozygosity, notably the change of the Mdh1 allozyme locus loosely linked to the M locus, on a theory of a sex conversion. It appeared that essentially for half of the loci tested the observed female genotype was different compared to the males it was expected to be derived from. The authors have tested eight allozyme loci where they found that a female plant was similar to the male plant at five loci: “bb” in Aat I “aa” in Aat 2 “bb” in Aat-3 “bc” in Pgm-1 and “ab” in Skdh-1. This is a low number of loci and it seems that the discriminative power of two of these similar loci, Aat I and Aat 2 may have been limited. Ozaki et al. (2000a) have shown that for nine cultivars tested, only two alleles were observed for Aat I and that the ‘bb’ homozygous genotype was observed in eight of these. It further seems that Aat 2 showed no variation at all. It should further be noted that two other loci Pdm-1 and Skdh-1 are closely linked (4-6cM see Ozaki et al., 2000a and reference therein) which also limits the discriminate power as these loci markers essentially target a similar locus. At another three loci differences were observed for the male controls plants vs the female plant, respectively; “an” vs. “nn” in Mdh I “an” vs. “un” in Mdh 2 and “an” vs. “aa” in Idh I.

The authors reasoned that the sex-conversion might be the result of the change of the genotypes from “Mm” to “mm” in sex determining locus and that ‘Mdh-1 and Idh-1 changed to be homozygous from heterozygous in accordance with the mutation’, Besides that this is highly speculative, the theory seems to be based on assumptions that are factually wrong. The authors cite the work of Maestri et al. (1991) which demonstrated the linkage of MdhI to the M-locus and this is indeed disclosed in the cited work. The authors also state that ‘three linkage pairs of Aat-1/Mdh-1, Aat-1/Idh-1 and Pgm-1/Skdh-1 were recognized previously (Ozaki et al, 2000b)’, but this is incorrect as Ozaki et al (2000b) found Idh1 to be linked to Aat3 rather than Aat1.

Therefore the scenario that both loci ‘changed in accordance with the mutation’ as if this would be an obvious event effecting (a part of) one and the same chromosome is not supported. To gain at least some evidence that Mdh1 loss of heterozygosity is connected to a mutation that could be associated with a hypothesized sex conversion, it must be established that the allegedly lost allele observed in the female has been linked in coupling phase or ‘in cis’ to the dominant M allele conferring the male phenotype in the original cultivar. Testing such an hypothesis is easily performed by a testcross such as made by Maestri et al. (1991) using a female that preferably homozygously differs at the MdhI locus from the cultivar Festo. Such an experiment has not been performed by Maeda et al. (2005) and this leaves the connection, in the sense of a being causal, between an allegedly lost MdhI allele and the alleged sex conversion unsolved.

The third variable locus, Mdh2, has not been found to be linked to Mdh1 (see Ozaki et al., 2000b).

An proprietary marker of Limgroup targeting an Mdh gene:

(SEQ ID NO: 11)

CAGCTATAGGGACGGTAGAATTTAC[C/T]GGGTTGCTAATGATGTGAAT

GA was found to be linked to Asp276:

(SEQ ID NO: 12)

GTAGATTCAAGGGAGTACGGCATTGGCGCGCAGATATTGCACGATCTTGG

[C/T]GTTCGGACAATGAAGTTGCTGACCAACAACCCGGCAAAATATAGC

GGGCT that was mapped to a chromosome designated chromosome 8 in a propriety mapping population, rather than to the sex chromosome.

This reconfirmed that Mdh1 found to be linked to the M locus and Mdh2 are not linkedMaeda et al. (2005) could have provided more conclusive data with this respect e.g. to clarify whether contamination that could have been inferred from the observed genetic variability has been a frequent event in the evaluation field. It is not explained why this second plants has not been tested.

In conclusion, the report of a sex conversion that according to Maeda et al (2005) has been identified, will be subject to debate to the person skilled in the art and will raise many unanswered questions to the person skilled in the art and thus provides insufficient teaching on whether a sex converted asparagus plant can he obtained by in vitro embryogenesis.

Hence, the breeder of monoecious plants, especially *Asparagus* plants is still in need of the availability of hermaphroditism that is simply inherited and thus is highly predictable and easily selected for or selected against in certain stages of breeding. Further, the skilled breeder would also be interested in enabling androecium development. Enabling androecium development in a female plant to essentially change the gender, would allow to obtain seeds from an originally female plant in the absence of cross pollination (thus by self-fertilizaton) and would provide the ability to obtain doubled haploids by in vitro androgenesis from such a plant.

SUMMARY OF THE INVENTION

The present invention relates to a method to improve breeding in dioecious plants comprising providing a plant in which the functional expression of the dominant suppressor of gynoecium development is disrupted or reduced and introducing said plant in inbreeding, backcross breeding, recurrent backcross breeding or double haploid seed production. In a further embodiment, the invention relates to a method for self-fertilisation or intercrossing of dioecious plants wherein one or both of the parent plants is a plant in which the functional expression of the dominant suppressor of gynoecium development is disrupted or reduced. In a yet further embodiment, the invention relates to a method to produce a plant, in which the functional expression of the dominant suppressor of gynoecium development is disrupted or reduced by inhibiting the expression of the GDS protein, preferably decreasing the expression of the amino acid sequence depicted in SEQ ID NO: 2 or an ortholog or functional homolog thereof. More particularly in these methods of the invention the disruption or reduction of the functional expression of the dominant suppressor of gynoecium development is caused by inhibiting expression of the GDS gene, preferably wherein the GDS gene comprises the sequence provided in SEQ ID NO:1 or is an ortholog, a functional homolog or a functional fragment thereof. Preferably, the methods of the invention comprise a step of introducing a mutation in the GDS gene to disrupt or reduce the functional expression of the dominant suppressor of gynoecium development. Consequently, it is preferred that the above cited methods use a plant that comprises a mutant GUS gene, preferably wherein the mutation is caused by a DNA replacement. In a preferred embodiment the methods of the invention are performed on a plant of the genus *Asparagus*, preferably *Asparagus* officinalis.

Also part of the invention is a dioecious plant, preferably a plant of the genus *Asparagus*, more preferably a plant of the species *Asparagus officinalis*, in which the expression of the dominant suppressor of gynoecium development protein is disrupted or reduced. Preferably in said plant the expression of the GDS gene is disrupted or reduced. In a further preferred embodiment said plant has been subject to a mutagenesis treatment, preferably wherein said treatment comprises radiation with a radioactive element. Further preferred with respect to said plants is that it has been transformed or transfected with a nucleotide sequence which is able to disrupt or reduce the expression of said dominant suppressor of gynoecium development, preferably wherein said nucleotide sequence is homologous or partly homologous to a sequence of the GDS gene, especially wherein said disruption or reduction of expression is reversible.

The invention also comprises a method to improve breeding in dioecious plants comprising providing a plant in which the functional expression of the dominant male stimulator is restored and introducing said plant in inbreeding, backcross breeding, recurrent backcross breeding or double haploid breeding techniques. In another embodiment, the invention comprises a method to improve breeding in dioecious plants comprising a plant wherein the lack of functional expression of the dominant male stimulator is complemented by a functional copy of the dominant male stimulator and introducing said plant in inbreeding, backcross breeding, recurrent backcross breeding or double haploid breeding techniques. Preferably in said methods the introduction of the dominant male stimulator is performed by inducing in a dioecious plant the expression of a heterologous dominant male stimulator, preferably wherein said dominant male stimulator is a TDF1 protein, preferably wherein said TDF1 protein is the *Asparagus officinalis* TDF1 gene as depicted in SEQ ID NO: 5 or an ortholog or functional homolog or functional fragment thereof, which functional fragment, preferably comprises at least the R2 and R3 domains of the TDF1 protein or ortholog or functional homolog thereof. In a further preferred embodiment the gene encoding the dominant male stimulator is the *Asparagus officinalis* TDF1 gene as depicted in SEQ ID NO: 4 or an ortholog or functional homolog thereof or a fragment thereof coding for a fragment of the TDF1 protein as defined above.

Further part of the invention is a method for self-fertilisation or intercrossing of dioecious plants wherein one or both of the parent plants is a plant in which the lack of functional expression of the dominant male stimulator is restored or complemented by a functional copy of the dominant male stimulator, preferably wherein said dominant, male stimulator is a TDF1 protein or ortholog or homolog thereof.

Also part of the invention is a method for in nitro androgenesis wherein the plants used for providing anthers is a plant in which the lack of functional expression of the dominant male stimulator is restored or complemented by a functional copy of the dominant male stimulator, preferably wherein said dominant male stimulator is a TDF1 protein or ortholog or homolog thereof.

Also part of the invention is a protein that is able to suppress gynoecium development in asparagus plants comprising the amino acid sequence of SEQ ID NO: 2 or an ortholog or functional homolog thereof. Further encompassed in the present invention is a nucleic acid sequence encoding said protein, wherein said nucleic acid sequence is the cDNA sequence as depicted in SEQ ID NO: 1 or the genomic sequence that can be derived from SEQ ID NO: 3.

Also part of the invention is a protein that is able to provide masculinization in a plant from a dioecious species, comprising the amino acid sequence of SEQ ID NO: 5 or an ortholog or functional homolog thereof or a fragment thereof as defined above. Further encompassed in the present invention is a nucleic acid sequence encoding the protein according to claim 23, wherein said nucleic acid sequence is the cDNA sequence as depicted in SEQ ID NO: 4 or the fragment thereof that is able to code for the fragment as defined above.

Also part of the present invention is a hybrid plant of a dioecious species obtained in a breeding scheme, preferably from an inbred plant produced through one of the breeding methods according to the present invention.

Further part of the invention is a method to improve breeding in dioecious plants comprising providing a feminized plant and introducing said plant in inbreeding, backcross breeding, recurrent backcross breeding or double haploid seed production.

Further comprised in the invention is a method to improve breeding in dioecious plants comprising providing a defeminized plant and introducing said plant in inbreeding, backcross breeding, recurrent backcross breeding or double haploid seed production.

Further comprised in the invention is a method to improve breeding in dioecious plants comprising providing a masculinized plant and introducing said plant in inbreeding, backcross breeding, recurrent backcross breeding or double haploid seed production.

Also comprised in the invention is a method to improve breeding in dioecious plants comprising providing a demasculinized plant and introducing said plant in inbreeding, backcross breeding, recurrent backcross breeding or double haploid seed production.

LEGENDS TO THE FIGURES

FIG. 1-A

Example of scaffold 905 to illustrate the read coverage of reads of DH00/094 (indicated as the 'XX Female Resequence' track) all of a sudden drops at position 104,688 (from 30× to zero) whereas the read coverage of the male DH00/086 (indicated as 'YY male mapping' track) remains high. This suggest that this region may represent the border between the autosomal part and the male specific part (MSY) of the sex chromosome.

FIG. 1-B

Example of scaffold 905 positions where the published markers Asp 1-T7 and Asp2-SP6 are located. Note that Asp2-T6 is located very close to predicted gene Aof31527.1. Sequence reads are lacking for the re-sequenced female (see the XX Female Resequence track) whereas abundant, reads occur for the re-sequenced male (indicated as 'YY male mapping' track). The lack of reads at position 312500 are the result of unknown sequences NNNN present in mate pair reads.

FIG. 1-C

Figure 1B:
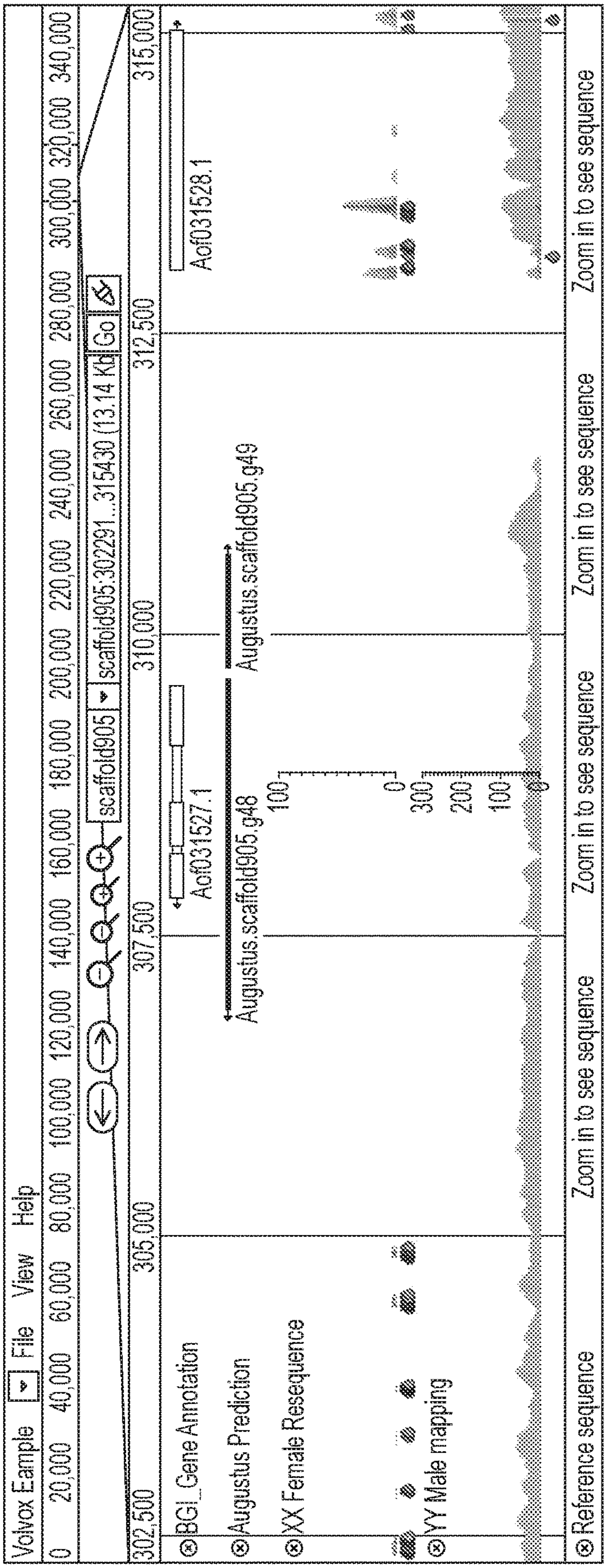
Figure 1C:
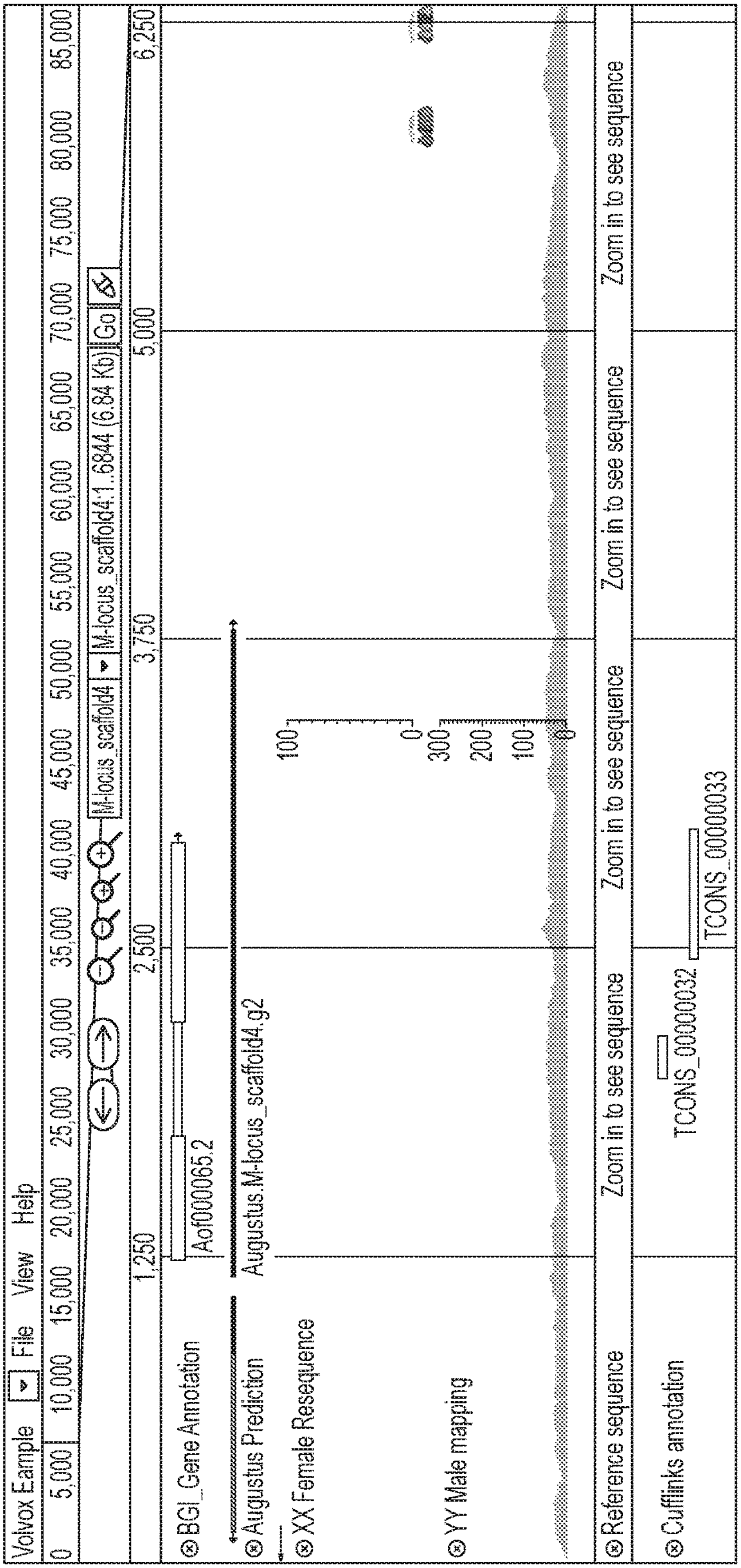

Example of Mlocus scaffold 4 positions where the published markers Asp1-T7 and Asp2-SP6 are located. Note that Asp2-T6 is located very close to predicted gene Aof0065.2. Sequence reads are lacking for the re-sequenced female (see the XX Female Resequence track) whereas abundant reads occur for the re-sequenced male (indicated as 'YY male mapping' track). Note that this representation resembles that presented for scaffold 905 (FIG. 1-C) but that the orientation is reversed. Further note that where in scaffold 905 the second exon is broken up on two parts it shows up as a single exon in Mlocus_scaffold 4. Sanger sequencing revealed that the Mlocus_scaffold 4 representation is accurate for the second exon and thus a better representation compared to Scaffold 905 which apparently comprises some minor assembly errors.

FIG. 2 (SEQ II) NO: 115)

Donor splice site intron2.

ML4 DUF247 at the position of the CDS2/Intron2 boundary. The EVM1 prediction is shown directly above the plus-strand sequence and predicts a putative 5'-splice site indicated by the black bar: TG/GC. Two cDNA sequences derived from RNA isolated from flower buds of genotype DH00/086 are below the minus-strand sequence indicated by CP35CR55_57 and CR55CR57_57. The actual splice site is indicated by cDNA 5'-splice site: GG/GT. The Cytosine at position 2795 has never been reported for plant donor splice sites. The Thymidine at position 2835 is 100% preserved.

FIG. 3A-C (SEQ ID NOS: 116.128)

Alternative cDNA sequences for the DUF247 gene based on different analyses of the genomic DNA of *Asparagus* officinalis.

FIG. 4

Short read alignment of G033 (shown as LIM_G033_Alignments) and K323 (shown as LIM_K323_Alignments) against the Y-linked M-locus_scaffold4 assembled scaffold annotated gene feature Aof000065.2. The track BGI gene annotations shows the FGENESH predicted exons in thick bars separated by a thinner line to show the predicted intron. EVM showed an evidence based gene model (for description see text of EXAMPLE 1). The dashed line border a region for which no reads are mapping for G033 which indicates that this part of the DUF247 essentially is deleted. Arrows indicate clip-reads (see text) indicative of a border of the insert.

FIG. 5 (SEQ ID NOS: 129.134)

A. Example of the two Sanger reads obtained from sequencing the hermaphrodite G033 using primer pair CN78/CN83 and a Sanger read of the Wild type hybrid using primer pair CN59/CN70 as reference. For primer pairs see Primer Table 3.

B. Alignment of sequenced males, hermaphrodite 5375 and hermaphrodite G033 to show the intron position at which the sequence of G033 appears different compared to the other reads.

FIG. 6.

Cumulative number of plants that flowered since the first plants of the pedigree of the 3E a pseudo test cross: female 1800×selected F1 (5375×1770) flowered (set as day 1). Solid lines curve represent cumulative number of flowers from male plants and the dashed line shows the cumulative number of flowers of hermaphrodite plants.

FIG. 7A

GENEVESTICATOR (www.genevestigator.org, NEBION AG, Zurich, Switzerland) experiment using all available gene expression data of 10 DUF247-like genes of *Arabidopsis* across 10 developmental stages of *Arabidopsis* lines. AT2G38540 is the unrelated *Arabidopsis* TDF1 gene. The Percent of Expression Potential is displayed for each gene-stage combination with six-group color indication.

FIG. 7B

GENEVESTICATOR (www.genevestigator.org, NEBION AG, Zurich, Switzerland) experiment using all available gene expression data of 9 color indicated DUF247-like genes of *Arabidopsis* across 10 developmental stages of *Arabidopsis* lines. AT2G38540 is the unrelated *Arabidopsis* TDF1 gene. The level of expression (signal intensity on *Arabidopsis* ATH1 genome array) is displayed for each gene-stage combination as LOW, MEDIUM or HIGH.

FIG. 7C

GENEVESTICATOR (www.genevestigator.org, NEBION AG, Zurich, Switzerland) experiment using all available gene expression data of 10 DUF247-like genes of *Arabidopsis* across 127 anatomical parts of *Arabidopsis* lines. The Percent of Expression Potential is displayed for each gene-anatomical part combination with six-group color indication. The *Arabidopsis* inflorescence data is shown in detail for flower organs, the relatively low values for gene expression in pistil data is highlighted.

FIG. 8A-E (portions of SER ID NOS: 137 and 139)

Overview of 2 gene predictions (dark) of FGenesh *ML4 DUF247 FG) and EVM (ML4 DUF247 EVM) and their respective coding sequences (CDS1, CDS2 for the FG prediction and CDS1-CDS3 for EVM prediction). The middle bars represent the generic sequence and corresponding coding sequences as detected by cDNA sequencing of mRNA from flower buds of DH Male DH00/086. The 5-splice site of intron2 has shifted 42 bp upstream in comparison to the EVM prediction.

FIG. 9A

GENEVESTICATOR (www.genevestigator.org, NEBION AG, Zurich, Switzerland) experiment using gene expression data of 10 DUF247 domain containing genes of *Arabidopsis* across selected anatomical parts of *Arabidopsis* wild type experiments. The selection included 4 datasets of young and developed flower expression data. AT2G38540 is the unrelated *Arabidopsis* TDF1 gene. The Percent of Expression Potential is displayed for each gene-anatomical part combination with six-group color indication. The *Arabidopsis* inflorescence data is shown in detail for flower organs, The relatively low values for gene expression for 8 genes is highlighted.

FIG. 9B

Figure 9A:
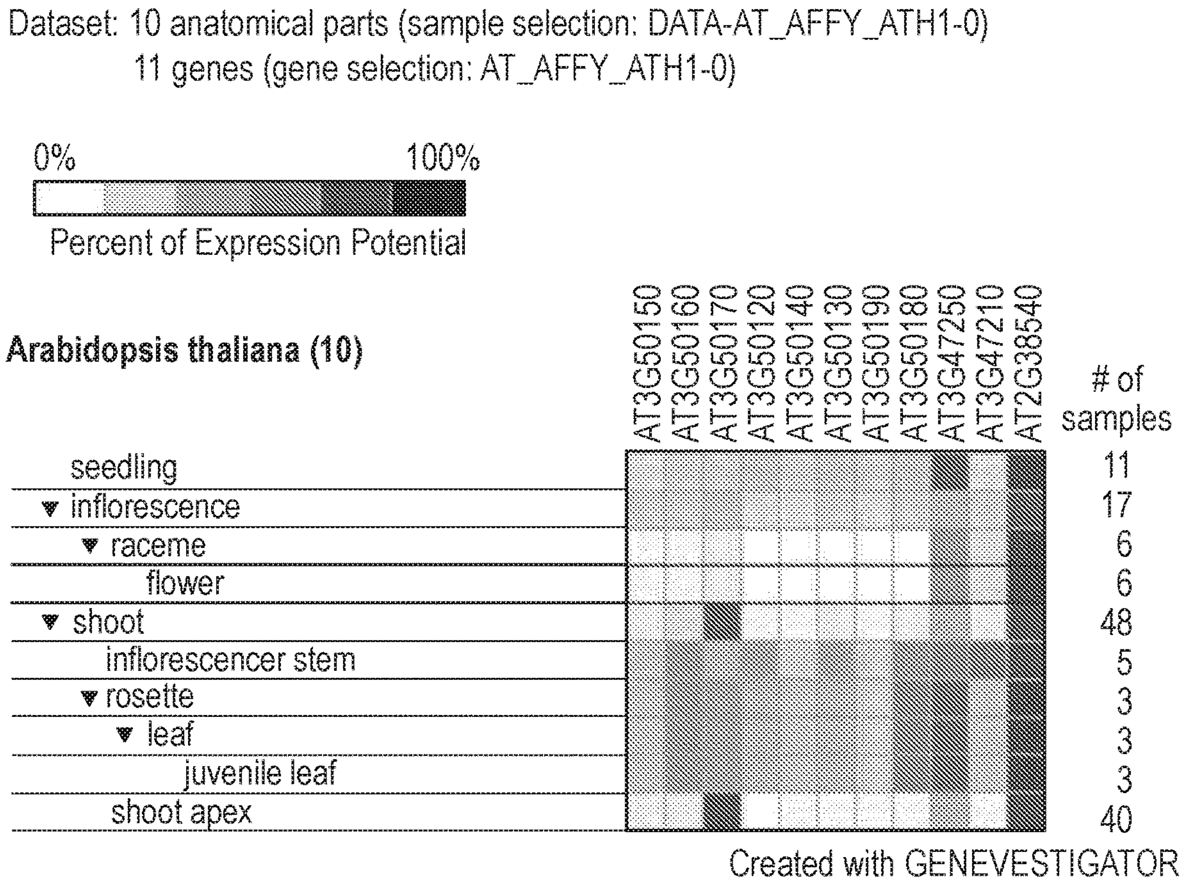

Detailed view of the gene expression data for individual flower experiments in FIG. 9A.

FIG. 9C

Hierarchical Clustering (Pearson correlation indices) of anatomical parts and Percent of Expression Potential indicated in FIG. 9A. High correlation values for the 3 clusters of genes is indicated by the length of lines in the respective correlation trees.

FIG. 10 (SEQ ID NOS: 135 and 136)

Sequence alignment of predicted coding sequence ML4 DUF247 EVM (depicted as EVM) and coding sequence for isoform ML4 DUF247 DH (depicted as DH) found in cDNA sequencing of DH00/086 flower buds derived total RNA. See table 6 for details of coding sequences.

FIG. 11

PCR products obtained for genoypes DH00/086 (the supermale of the reference genome sequence), hermaphrodite mutant G033 and supermale K323 using primer pairs CN78/83) and CN78/CN84, respectively left and right from the 100 bp size ladder which are diagnostic for the deletion insertion event, thus unique sequences in the DUF247 gene of hermaphrodite mutant G033. Note a unique and prominent PCR product for G033 whereas the other (male) samples show aspecific fingerprint-like patterns.

FIG. 12

A: Phenotype of hermaphrodite G33 which shows full berry set. B: Flowers of three WT K323 plants (left hand side) next to three G033 flowers; note that the flowers of the hermaphrodite G033 shows longer styles, and better developed stigma's and larger fruits compared to the WT K323 male plants. C: The difference in organ development of the G033 flower (left) and two flowers of all male hybrid K323 (the two at the right) next to a ruler to allow estimation of size differences.

FIG. 13A-DH (SEQ ID NOS: 137.147)

Sanger reads obtained from PCR fragment sequencing using genoytpes DH00/086, 9M, 88M, K323, hermaphrodite 5375 and hermaphrodite G033 as template DNA and sequences of the scaffolds that are mentioned in the present application: |el|M-locus_scaffold4, Scaffold 905, Scaffold 3098, scaffold 10515.

FIG. 14

'Examples of Flower Phenotypes'

Example of the female flower of the breeding line used as female in the test-cross and two typical flowers that are representative for both phenotypic classes that segregate in 861BC1d.

FIG. 15

"CHG Methylation and read coverage of K1036 vs DH00/086 and line 9 at Scaffold_905" Per position CHG methylation levels are plotted as a bar graph for line K1036 (top graph) and for DH00/086 and line 9 (bottom graph) for Scaffold_905 for position 49.815 to 51.249 (genome version 2.0). Per position informative read coverage is plotted with crosses for K1036 and triangles for DH0086 and circles for line 9. Depending on the strand of the CHG position, informative reads solely derive from either Watson or Crick strand. Note that for K1036 many CHG positions are methylated (indicated by numerous bars) whereas the CHG methylated positions of DH00/086 and line 9 are very limited; note that there is only a small number of bars to indicate methylation for DH00/086 and line 9 which means that at many other CHG positions the methylation levels is equal to 0% (absence of bars).

FIG. 16.

Size distribution of PacBio long sequencing reads of 4.6× coverage of *Asparagus officinalis* Male DH00/086.

FIG. 17.

BioNano contig BNG28 and its aligned AGS V2.0 scaffolds in the M locus region. Arrows and primer codes show the location of primers tested in PCR to analyze the loss of hemizygosity or loss of heterozygosity which is diagnostic for the size of the deletion caused by Cobalt 60 gamma irradiation.

FIG. 18. (SEQ ID NO: 148)

TDF-like CDS of *Asparagus officinalis*. Exons are in capital font and shaded.

FIG. 19. (SEQ ID NO: 149)

The 276 AA translation of the MYB34-like asparagus ortholog of Defective in Tapetal Development and Function 1 gene, homologous to *Arabidopsis* AT3G28470) and *Oryza sativa* osTDF1 (LOC_Os03g18480).

FIG. 20A-B. (SEQ ID NOS: 150-175)

tBLASTN result using ATH TDF1 as Query on a Database of AGS V2.0 assembly. AGHS 2.0 scaffold 436 and 1220 have the highest identities. Yet AGS V2.0 scaffold 1220 has a lower identity in the first SANT domain.

FIG. 21.

Fingerprinting using microsatellite markers (sat) and HRM markers to confirm the authenticity of mutants found in particular hybrids. Mutants genotypes are shown together with control hybrids to which those mutants belong Several controls plants are shown to illustrate the variability that is commonly observed for those markers. Parental alleles of those hybrids are shown (when known).

FIG. 22

Images of flowers of mutants of hybrid K1150, K1129 and K323 obtained after Cobalt 60 irradiation and reference control flowers. For descriptions see Example 6 and Example 7.

FIG. 23A-B

Example to show the read depth for the scaffold parts. One harboring the As-TDF1, and one harboring the GDS gene having a DUF247 domain. Note that the read depth observed for the male-to-female mutants is lower and/or that reads are absent indicative of the fact that the deletion overlaps both the Y specific and the pseudo-autosomal region.

FIG. 24A-E

Represents the compositions of SEQ ID NOS: 1-6.

Definitions

In this description, unless indicated otherwise, the terms and definitions used herein are those used in (Mendelian) genetics, for which reference is made to M. W. Strickberger, Genetics, second Edition (1976), in particular pages 113.122 and 164-177. As mentioned therein, "gene" generally means an inherited factor that determines a biological characteristic of an organism (i.e. a plant), and an "allele" is an individual gene in the gene pair present in a multiploid organism, such as a diploid (asparagus) plant A natural staminose plant defines as plant that naturally has one or more functional anthers producing functional pollen.

The term staminose is defined as having a flower with one or more functional anther(s) producing functional pollen and excludes female plants. The term staminose may be similar to the term staminose as used in Hendersons Dictionary of Biological terms, 11th edition p560 but may not he similar to staminate which in the same handbook is described as flower containing stamens but no carpels.

Syngeneic is used to define genetically identical

Gynoecium refers to a collective term for the parts of a flower that produce ovules and ultimately develop into the fruit and seeds. The gynoecium may consist of one or more separate pistils. A pistil typically consists of an expanded basal portion called the ovary, an elongated section called a style and an apical structure that receives pollen called a stigma.

Gynoecium development refers to development of the gynoecium to produce ovules and ultimately develop into fruit and seeds.

A natural female plant is a plant that produces only flowers that have fully developed female organs, such as a style and stigma and ovary that allow fruit set and only produces rudimentary non-functional anthers as can he found in nature because it naturally lacks a dominant suppressor of gynoecium development and naturally lacks a dominant gene conferring androecium development.

Feminization or being feminized is defined as restoring or enhancing the gynoecium development of a plant by disrupting or decreasing the functional expression of the suppressor of gynoecium development (GDS) gene, its homolog(s) or ortholog(s), as defined in present document as the result of human intervention.

The restored or enhanced development of the gynoecium in a feminized plant may be determined by the skilled person in comparing it to a suitable reference plant, exposed to identical growing conditions, where in case that a feminized plant produces less functional pollen compared to the reference plants, it will be pollinated in such a way that pollination itself will not limit fruit set. Said reference plant will have the same ploidy level as the feminized plant, is not a female, and in said reference plant the functional expression of the suppressor of gynoecium development (GDS) gene, its homolog(s) or ortholog(s), disclosed in present document has not been disrupted or decreased. Most preferably, the reference plant is syngeneic to the feminized plant that is evaluated. Examples of preferred reference plants are syngeneic plants obtained by vegetative propagation of a plant to be feminized, prior to the human intervention targeting its GDS gene, preferably by a short propagation step to avoid somaclonal variation which may render two plants insufficiently syngeneic for a proper comparison. Another preferred example of a suitable reference is (an average or member of) a large number of full siblings resulting from a cross between two doubled haploid parents, or true breeding (thus highly inbred) parents that are the same parents of the hybrid, from which the feminized plant to be evaluated results, where said full siblings or any of their parents have not been the subject of human intervention targeting a suppressor of a gynoecium development (GDS) gene, its homolog(s) or ortholog(s). In case the aforementioned preferred reference plants are not available, for example in case the human intervention targeting the suppressor of gynoecium development (GDS) gene was performed on a gamete the skilled person may take a sufficiently large number of siblings, which are not female plants, where said sibling or any of their parents have not been the subject of such human intervention, as reference to the feminized plant. If these siblings are not available or low in number the skilled person can take as reference the direct male ancestor of the feminized plant as reference plant, where said male ancestor has not been the subject of human intervention targeting the suppressor of a gynoecium development (GDS) gene, its homolog(s) or ortholog(s). To have said male ancestor available, the person of skill may vegetative propagate the ancestor.

When reference plants are genetically variable, which would hamper the comparison with highly syngeneic reference plants the skilled person may test whether the zero hypothesis that the trait of restored or enhanced gynoecium development of the feminized plant segregates independently of the targeted GDS gene and/or its homolog(s) or ortholog(s) in a suitable test cross population should be accepted or rejected. Fine mapping and phenotyping may then provide further clarification on the rol of the GDS gene in the feminization.

Restoring or enhancing gynoecium development as used in the definition of feminization means that a plant, in which the gynoecium development is enhanced or restored, is better capable of producing berries comprising viable seeds compared to a suitable reference plant.

Enhanced or restored gynoecium development may include an increase in style length and more conspicuous stigma which can be measured or inferred by on a scale such as has been applied by Franken (1969, 1970) and Beeskov (1967), Enhancing or restoring gynoecium development on the aforementioned scales means that flower(s) of the feminized plant will obtain a higher score on said scales compared to the scores of the reference plant.

Defeminization or being defeminized is defined as disrupting or decreasing gynoecium development, by restoring or increasing the functional expression of the suppressor of gynoecium development (GDS) gene, its homolog(s) or ortholog(s), as defined in present document, as the result of human intervention.

The disrupted or decreased gynoecium development a defeminized plant may be determined by the skilled person in comparing it to a suitable reference plant, exposed to identical growing conditions, where in case that a reference plant produces less functional pollen compared to the defeminized plants, it will be pollinated in such a way that pollination itself will not limit fruit set. Said reference plant will have the same ploidy level as the defeminized plant, is a staminose plant, and in said reference plant the functional expression of the suppressor of gynoecium development (GDS) gene, its homolog(s) or ortholog(s), disclosed in present document has not been restored or increased. Most preferably, the reference plant is syngeneic to the feminized plant that is evaluated. Examples of preferred reference plants are syngeneic plants obtained by vegetative propagation of a plant to be defeminized, prior to the human intervention resulting in restoring or increasing functional expression of a GDS gene, preferably by a short propagation step to avoid somaclonal variation which may render two plants insufficiently syngeneic for a proper comparison. Another preferred example of a suitable reference is (an average or member of) a large number of full siblings resulting from a cross between two doubled haploid parents, or true breeding (thus highly inbred) parents that are the same parents of the hybrid, from which the defeminized plant to be evaluated results, where said full siblings, or any of their parents, have not been the subject of human intervention resulting in restoring or increasing functional expression of a suppressor of a gynoecium development (CDS) gene, its homolog(s) or ortholog(s) In case the aforementioned preferred reference plants are not available, for example in case the human intervention restoring or increasing functional expression of a suppressor of gynoecium development (GDS) gene, was performed on a gamete the skilled person may take a sufficiently large number of siblings, which are staminose plants, where said siblings or any of their parents, have not been the subject of such human intervention, as reference to the feminized plant. If these siblings are not available or low in number the skilled person can take as reference the staminose ancestor of the defeminized plant as reference plant, where said male ancestor has not been the subject of human intervention resulting in restoring or increasing functional expression of a suppressor of a gynoecium development (GDS) gene, its homolog(s) or ortholog(s). To have said male ancestor available, the person of skill may propagate the ancestor vegetatively.

When reference plants are genetically variable, which would hamper the comparison with highly syngeneic reference plants skilled person may test whether the zero hypothesis that the trait of disrupted or decreased gynoecium development of the defeminized plant segregates independently of the restored or increased functional expression of the GDS gene and/or its homolog(s) or ortholog(s) in a suitable test cross population should be accepted or rejected. Fine mapping and phenotyping may then provide further clarification on the rol of the GDS gene in the defeminization.

Disrupting or decreasing the gynoecium development as used in the definition of defeminization, means that a plant, that has said disrupted or decreased gynoecium development, is less capable of producing berries comprising viable seeds compared to a suitable reference plant.

Disrupting or decreasing gynoecium development, as used in the definition of defeminization may include a decrease in style length and a less conspicuous stigma which can be measured or inferred by on a scale such as has been applied by Franken (1969, 1970) and Beeskov (1967), Decreasing or disrupting gynoecium development on the aforementioned scales means that flower(s) of the defeminized plant will obtain a lower score on said scales compared to the scores of the reference plant.

The human intervention referred to in the present definition of feminization or defeminization includes any form of induced mutagenesis, be it by irradiation, chemical treatment or any other means of mutagenesis. It also comprises any form of disruption (feminization) or restoration (defeminization) of the gene or interference with the transcription and translation of the gene. Examples for this are genetic modification of the coding sequences, induction of splice variants, epigenetic changes due to methylation, inhibition of expression by RNAi, CRISPRi, anti-sense expression, modification of sites in the cis-regulatory elements of the gene, and the like. Also included is crossing of plants that have a mutated gene with unmodified plants and selecting of offspring under guidance of marker assisted selection for the presence of the mutated GDS gene.

Masculinization or being masculinized is defined as restoring or enhancing the androecium development by restoring or increasing the functional expression of the dominant male stimulator (e.g. AsOsTDF1), its homolog(s) or ortholog(s), as defined in present document is restored or increased as the result of human intervention.

Restoring or enhancing androecium development in a masculinized plant may be determined by the skilled person in comparing it to a suitable reference plant, exposed to identical growing conditions. Said reference plant will have the same ploidy level as the masculinized plant, is not a natural staminose plant, and in said reference plant the functional expression of the male stimulator gene, its homolog(s) or ortholog(s), disclosed in the present document has not been restored or increased. Most preferably, the reference plant is syngeneic to the masculinized plant that is evaluated. Examples of preferred reference plants are syngeneic plants obtained by vegetative propagation of a plant to be masculinized, prior to the human intervention resulting in restoring or increasing the functional expression of a male stimulator gene, preferably by a short propagation step to avoid somaclonal variation which may render two plants insufficiently syngeneic for a proper comparison. In case the aforementioned preferred reference plants are not available, for example in case the human intervention resulting in restoring or increasing the functional expression of a male stimulator gene, was performed on a gamete, the skilled person may take a sufficiently large number of siblings, which are not staminose plants, where said siblings or any of their parents, have not been the subject of such human intervention, as reference to the masculinized plant. If these siblings are not available or low in number the skilled person can take as reference the direct female ancestor of the masculinized plant as reference plant, where said female ancestor has not been the subject of human intervention resulting in restoring or increasing the functional expression of its male stimulator gene, its homolog(s) or ortholog(s). To have said female ancestor available, the person of skill may propagate the ancestor vegetatively.

When reference plants are genetically variable, which would hamper the comparison with highly syngeneic reference plants skilled person may test whether the zero hypothesis that the trait of restored or enhanced androecium development of the masculinized plant segregates independently of the restored or increased functional expression of a male stimulator and/or its homolog(s) or ortholog(s) in a suitable test cross population should be accepted or rejected. Fine mapping and phenotyping may then provide further clarification on the role of the targeted male stimulator gene n the masculinization.

Restoring or enhancing androecium development as used in the definition of masculinization means that a plant, obtaining said enhanced or restored androecium development, is better capable of producing functional anthers comprising functional pollen compared to a suitable reference plant.

Enhancing or restoring androecium development may include an increase in filament length, a larger anther (thus increased in size), having a tapetal (or tapetum) development comparable to a natural staminose plant. Tapetal development comparable to a natural staminose asparagus plant means, that it will show no, or at least less tapetal degeneration compared to what is typically observed in natural females.

Demasculinization or being demasculinized is defined as disrupting or decreasing the androecium development of a plant by disruption or decreasing the functional expression of the suppressor of the dominant male stimulator (e.g. AsOsTDF1), its homolog(s) or ortholog(s), as defined in present document is disrupted or decreased as the result of human intervention.

Disrupting or decreasing androecium development in a demasculinized plant may be determined by the skilled person in comparing it to a suitable reference plant, exposed to identical growing conditions. Said reference plant will have the same ploidy level as the demasculinized plant, is a staminose plant, and in said reference plant the functional expression of the male stimulator gene, its homolog(s) or ortholog(s), disclosed in present document has not been disrupted or decreased. Most preferably, the reference plant is truly syngeneic to the demasculinized plant that is evaluated. Examples of preferred reference plants are syngeneic plants obtained by vegetative propagation of a plant to be demasculinized, prior to the human intervention targeting the male stimulator gene, preferably by a short propagation step to avoid somaclonal variation which may render two plants insufficiently syngeneic for a proper comparison. Another preferred example of a suitable reference is (an average or member of) a large number of full siblings resulting from a cross between two doubled haploid parents, or true breeding (thus highly inbred) parents that are the same parents of the hybrid, from which the demasculinized plant to be evaluated results, where said full siblings, or any of their parents, have not been the subject of human intervention targeting a male stimulator gene, its homolog(s) or ortholog(s) In case the aforementioned preferred reference plants are not available, for example in case the human intervention targeting a male stimulator gene; was performed on a gamete the skilled person may take a sufficiently large number of siblings, which are staminose plants, where said siblings or any of their parents, have not been the subject of such human intervention, as reference to the demasculinized plant. If these siblings are not available or low in number the skilled person can take as reference the direct male or staminose ancestor of the demasculinized plant as reference plant, where said staminose ancestor has not been the subject of human intervention targeting its male stimulator gene, its homolog(s) or ortholog(s). To have said staminose ancestor available, the person of skill may vegetative propagate the ancestor.

When reference plants are genetically variable, which would hamper the comparison with highly syngeneic reference plants skilled person may test whether the zero hypothesis that the trait of disrupted or decreased androecium development of the demasculinized plant segregates independently of the targeted male stimulator and/or its homolog(s) or ortholog(s) in a suitable test cross population should be accepted or rejected. Fine mapping and phenotyping may then provide further clarification on the rol of the targeted male stimulator gene in the demasculinization.

Decreasing or disrupting androecium development as used in the definition of demasculinization means that a plant, obtaining said disrupted or decreased development is less capable of producing functional anthers comprising functional pollen compared to a suitable reference plant.

Decreasing or disrupting androecium development may include a decrease in filament length, a smaller anther (thus decreased in size), having a tapetal (or tapetum) development comparable to a natural female plant such as showing tapetal development comparable to a natural female plant means, that it will show equal absence of tapetal development as typically observed in female plants or at least less tapetal development compared to what is typically observed in staminose plants The human intervention referred to in the present definition of masculinization and demasculinization includes any form of induced mutagenesis, be it by irradiation, chemical treatment or any other means of mutagenesis. Tt also comprises any form of restoration (masculinization) or disruption (demasculinization) of the gene or interference with the transcription and translation of the gene. Examples for this are genetic modification of the coding sequences, induction of splice variants, epigenetic changes due to methylation, inhibition of expression by RNAi, CRISPRi, anti-sense expression, or modification of cis-regulatory elements of the gene and the like. Also included is crossing of plants that have a mutated gene with unmodified plants and selecting of offspring under guidance of marker assisted selection for the presence of the mutated male stimulator gene.

Male ancestor is defined as a staminose plant capable of producing functional anthers belonging to pedigree of a plant from which the latter plant is derived, which may include vegative propagation of the ancestor its somatic cells or somatic tissue from which a plant is derived.

A pedigree, is a list of the ancestors from which a plant has descended

Suppression of gynoecium development or inhibition of gynoecium development is defined as the phenomenon, typically observed in male and andromonoecius (thus different from hermaphrodite) or neuter plants that a dominant suppressor gene hampers the development of the gynoecium. Commonly, suppression of gynoecium development is not observed in natural females, or natural hermaphrodites which produce many berries, comprising viable seeds, and should produce berries from all of their flowers, provided that those plants are growing under optimal conditions and provided that those plants can be fertilized by viable pollen and do not suffer from inbreeding depression or mutations that may cause reduced fitness affecting fruit set. Plant hypothesized to exhibit suppression of gynoecium development do not set fruit from their flowers or not from all of their flowers, even when they grow under optimal conditions and can he fertilized by viable pollen and do not suffer from inbreeding depression or mutations, that may cause reduced fitness affecting fruit set. Apart from a decreased capability to produce berries, comprising viable seeds, plants which show suppression of gynoecium development are expected to exhibit a significantly decrease in style length and/or a less conspicuous stigma which may be measured or inferred using a scale such as has been applied by Franken (1969, 1970) and Beeskov (1967). According to the scale of Beeskov (1967), a plant showing suppression of gynoecium development is expected to have flowers that will be classified with a score less than IV, preferably less than Ill preferably less than II preferably equal to I. According to the scale of Franken (1969, 1970) a plant showing suppression of gynoecium development is expected to have flowers that will be classified with a score less than 5, preferably less than 4 preferably less than 3, preferably less than 2, preferably equal to 1. Suppression of gynoecium development is expected to be the result of functional expression of a gynoecium development suppressor GDS gene, that is homologous to sequences provided in present document. That a dominant suppressor gene is active in a plant may be tested by phenotyping the test-cross progeny of a plant and rejecting the hypothesis that a disrupted gynoecium development phenotype and markers linked to the M-locus such as those that are described in the art segregate independently.

Androecium refers to a collective term for the stamens of a flower, where a stamen typically consists of a stalk called the filament and an anther which contains microsporangia in which pollen grains develop from macrospores.

TDF1 marker assisted selection is defined as marker assisted selection having an aim to introduce any mutation that induces masculinization or demasculinzation or that is guided by information based on assays (such as but not limited to Sanger Sequencing, CAPS markers analysis, high resolution melting curve marker analysis, Taqman assays, Kasp assays, etc.) designed to elucidate sequence information of the TDF1 gene, its homologs or orthologs disclosed in present document into a plant pedigree. TDF1 marker assisted selection may also include using information, designed to elucidate sequence information of the TDF1 gene, its homologs or orthologs of a parental plant, following introduction of a desired TDF1 gene allele in a pedigree, where other markers than those targeting the TDF1 gene are used that are sufficiently linked, preferably within 20cM, more preferably within 10cM, more preferably within 5cM, more preferably within 1cM, to the desired TDF gene allele.

GDS marker assisted selection is defined as marker assisted selection having an aim to introduce any mutation(s) that induces feminization or that is guided by information that may be based on sequencing or assays (such as but not limited, CAPS markers analysis, high resolution melting curve marker analysis, Taqman assays Kasp assays etc) designed to elucidate sequence information of the GDS gene, its homologs or orthologs disclosed in present document into a plant pedigree. GDS marker assisted selection may also include using information, designed to elucidate sequence information of the GDS gene, its homologs or orthologs of a parental plant, following introduction of a desired GDS gene allele in a pedigree, where other markers than those targeting the GDS gene are used that are sufficiently linked, preferably within 20cM, more preferably within 10cM, more preferably within 5cM, more preferably within 1cM, to the desired GDS gene allele.

Mutagenesis or mutagenesis treatment is defined as enabling, preferably enhancing, the process by which the genetic information of an organism is changed in a stable manner, resulting in a mutation that is achieved experimentally, thus which is different from a mutation arising spontaneously in nature, by applying a non-natural doses of irradiation or unnatural exposure to a mutagenic agent.

The dominant male stimulator (gene) is a gene linked to, or present at the M locus that confers the development in staminose plants or gene product derived from this gene. This dominant male stimulator (also indicated as stimulator of androecium development or stimulator of anther development) is a protein that is encoded by a gene that is identical to or a homolog or ortholog of the TDF1 (defective in Tapetal Development and Function) gene, which is found in *Arabidopsis* AT3G28470 and in rice (osTDF1, LOC_Os03g18480). The sequences of the orthologous gene in *Asparagus officinalis*, AsOsTDF1, are provided by SEQ ID NO:4, SEQ ID NO:5, and SEQ ID NO:6.

For several reasons the procedure of somatic embryogenesis described in the section "protoplast culture' of Maeda et. al (2005) including reference to a method of Kunitake and Mii (1990) and transplanting the plants obtained by said somatic embryogenesis to a field is not included as an embodiment of human intervention of enhancing physical characteristics of the gynoecium. As has been discussed in the present document reviewing the literature, the work of Meada (2005) provides insufficient teaching to the skilled person that a sex converted plant has been obtained from somatic embryogenesis and that this would provide a workable method. Although it can not be fully excluded that sufficiently proven sex converted plants may ever be generated by the embryoculture followed by transplanting as applied by Maeda et al (2005), the authors of the present invention have no problem to exclude the method described by Maeda et al (2005) as human intervention used to define feminization in the present document. The skilled person will understand that any method of human intervention which extends to somatic embryogenesis and transplanting described by Maeda et al (2005) thus includes additional steps. Preferably said steps would comprises the application of mutagenesis or GDS marker assisted selection, either before or after somatic embryogenesis, but excluding conventional crossing to generate viable offspring as the sole additional human intervention. In such a way it might be possible to obtain a feminized plant, which then would be a different method.

A natural male asparagus plant is defined as a plant that is capable of producing flowers with fully developed anthers as can be found in nature because it has at least one natural functional copy of the dominant asparagus gene homologous to defective in tapetum development and Function 1 (TDF1).

A plant is called "homozygous" for a gene when it contains the same alleles of said gene, and "heterozygous" for a gene when it contains two different alleles of said gene. The use of capital letters indicates a dominant (form of a) gene and the use of small letters denotes a recessive gene: "XX" therefore denotes a homozygote dominant genotype for gene or property X; "Xx" or "xX" denote heterozygote genotypes; and "xx" denotes a homozygote recessive genotype. As is commonly known, only the homozygote recessive genotype will generally provide the corresponding recessive phenotype (i.e. lead to a plant that shows the property or trait "x") whereas the heterozygotic and homozygote dominant genotypes will generally provide the corresponding dominant phenotype (i.e. lead to a plant that shows the property or trait "X"), unless other genes and/or factors such as multiple alleles, suppressors, codominance etc. (also) play a role in determining the phenotype. A plants is called "hemizygous", when it has only one member of a chromosome pair or chromosome segment rather than the usual two; more specifically in the present description the term hemizygous refers to certain Y linked genes, thus in the male chromosome, in a way that a male plant has a chromosome segment that is lacking in females.

As used herein, the term "plant" includes the whole plant or any parts or derivatives thereof, such as plant cells, plant protoplasts, plant cell tissue cultures from which plants (e.g. *Asparagus officinalis* plants) can be regenerated, plant calli, plant cell clumps, and plant cells that are intact in plants, or parts of plants, such as embryos, pollen, ovules, fruit (e.g. harvested tomatoes), flowers, leaves, seeds, roots, root tips and the like.

An ortholog or orthologous gene according to the present invention would be a gene that has evolved divergently between species or even varieties. This means that an ortholog of the GDS gene as defined herein would mean any gene in a species different from the species or variety from which the GDS sequence in this application has been derived and having evolved from the same ancestral sequence. It will be recognized that in most, if not all, of the cases of orthologous genes, the function of said gene is maintained. In this sense, automatically, an ortholog of the GDS gene as specified herein has the same function as described in the application for the GDS gene of *Asparagus officinalis*. Orthologs may share a large degree of homology, but not necessarily. Often orthologous genes in a different species are found in the similar genetic environment, i.e. clustered within a gene cluster that can be said to be orthologous for most of the genes present in the cluster.

A homolog or homologous sequence according to the present invention is a sequence which has a high level of sequence identity with the sequence of which it is said to be a homolog. A high sequence identity or high homology in this respect means for a nucleic acid sequence that two homologous sequences would selectively hybridize, under selective hybridization conditions, to each other. A homologous nucleic acid is said to be a functional homolog or a functional homologous sequence if it would code for an amino acid sequence which has a biological function similar to the function of the protein encoded by the gene of which it is said to be homologous with.

In this sense, the definition of high sequence identity in the present invention includes nucleotide sequences which have a percentage of identity related to the sequences with which they are said to be homologous of 65% to 95%. Thus, for example, the percentage of identity can be at least, 65%, 70%, 75%, 80%, 85%, 90%, or 95%. Sequence identity on basis of nucleotide sequences can be calculated by using the BLASTN computer program (which is publicly available, for instance through the National Center for Biotechnological Information, accessible via the internet on http://www.ncbi.nlm.nih.gov/) using the default settings of 11 for wordlength (W), 10 for expectation (E), 5 as reward score for a pair of matching residues (M), −4 as penalty score for mismatches (N) and a cutoff of 100. Alternatively, the homology can be calculated on basis of the amino acid sequence of the protein encoded by said nucleotide sequences. For amino acids, the sequence identity can be calculated through the BLASTP computer program (also available through http://www.ncbi.nlm.nih.gov/). On the amino acid level functional homologs are defined as amino acid sequences having a sequence identity of at least 50%, preferably at least 55%, more preferably at least 60%, more preferably at least 70%, more preferably at least 80%, more preferably at least 90%, more preferably at least 95% to the amino acid sequence of said protein. Functional homologs or orthologs of proteins are defined as having a biological function similar to the protein with which they are said to be homologous or orthologous to. A nucleic acid sequence encoding an amino acid sequence can have many variants. Because of the nature of the genetic code there are different triplets of nucleotides that would translate into one and the same amino acid. It is to he understood that a nucleic acid encoding a protein may vary considerably without resulting in a different amino acid sequence. Such a wobble of the genetic code may not influence the homology level of two nucleic acid sequences encoding a homologous or orthologous protein: if the encoded protein is deemed to be highly homologous or orthologous according to the definition as used herein, then also the encoding nucleic acids should be considered to be highly homologous.

DETAILED DESCRIPTION OF THE INVENTION

It is a first object of the present invention to provide a method for changing the gender or sex of a plant by changing the expression of a female suppressor gene and/or changing the expression of a gene that enables androecium development. Further object is an alternative method for self fertilization or intercrossing of dioecious plants, preferably asparagus plants, by using a loss of function of a female suppressor gene and/or by providing a gene that enables androecium development.

It is a second object to provide a technical teaching on how 'feminized plants' a hermaphrodite, or partly hermaphrodite or andromonoecius plant, or a female plant preferably from the genus *Asparagus* can be obtained unequivocally, in a way that differs from those known in the art.

A third object is to provide technical teaching on how female plants could be masculinized into male plants that have a functional androecium.

It was established in the present invention by carefully designed testcrosses that monogenic recessive sex linked inheritance of a feminized plant, in particular of a hermaphrodite phenotype exists. Further, this sex linked dominant repressor of gynoecium development was identified. Characterization of this gene revealed that this is a DUF 247 domain containing gene. Ten mutants, having either a hermaphrodite or female phenotype were found, all of them containing a different mutation relating to the expression of this gene, designated in the present invention as the GDS gene. Some mutants were found to also lack the expression of a functional TDF1 gene (the Defective in Tapetal Development and Function 1 gene, homologous to *Arabidopsis* AT3G28470) and *Oryza sativa* osTDF1 (LOC_Os03g18480) which changed their phenotype from male to female.

This existence of a monogenic recessively inherited sex linked hermaphrodite phenotype, tested for its segregation in pedigrees of three independent mutants, suggests that the gene conferring feminization is the dominant female suppressor in asparagus that has been predicted for dioecious species in general by evolutionary biologists (Westergaard, 1958, Charlesworth and Charlesworth, 1978) but which never been convincingly proven to exist in asparagus. The present invention teaches that such a female suppressor indeed exists in asparagus and can be manipulated in such a way that it looses its female suppressing ability and converts an originally strictly male plant into a plant that has perfect flowers that can be self-fertilized and/or crossed to another male plant or that, in case the manipulation of the female suppressor is lost together with the male stimulator, an originally male plants can be converted into a female plant. Furthermore, the present invention describes that an allele of the female suppressor that has lost its female suppressing ability can be introduced/introgressed together with a genetically linked male (pollen) fertility in other plants to create new hermaphrodite plants. The present invention describes a method that is different from existing means of self fertilization or crossing to other male plants such as using andromonoecious plants or hermaphrodite plants for which other genetic models have been described—or at least have been genetically more complex—than the simple monogenic recessive inheritance that is exploited in the present invention. Further, the invention comprises a method to provide such a plant, also wherein said plant only temporarily expresses this phenotype.

In addition the invention discloses a method to change female plants into male plants which should be accomplished by introducing a functional copy or the gene product of a TDF1 gene.

The skilled person will understand that switching the female suppressor on and off or, more subtly, partly enhancing or reducing suppression of gynoecium development is used in its broadest interpretation. Enabling or enhancing the suppression of gynoecium development can be the result of providing a functional copy of the gene that confers suppression of gynoecium development. 'Switching off', disabling or reducing the suppression of gynoecium development would include any method to reduce the expression or functionality of gene conferring suppression of gynoecium development. The skilled person will also understand that application of switching the gene conferring suppression of gynoecium development on and off or reducing and enhancing suppression of said gene is not limited to only providing plants that carry functional anthers. If the gene conferring suppression of gynoecium development of a male plant is (partly) switched off (e.g. reduced in functional expression) it indeed may result in (more) andromonoecious plants or hermaphrodite plants. However, reduction of suppression of gynoecium development may also coincide with the absence or reduction of anther functionality such as, but not limited to, the event that both the suppressor of gynoecium development and the stimulator of anther development are jointly disrupted by a single deletion. In such a case, a male or andromonoecious plant is changed into a female plant and such events (in which changing both the dominant suppressor of gynoecium development coincides with disruption of the stimulator of androecium development) are also included in the present invention as methods to control the functionality of the suppressor of gynoecium development.

In this context it is understood that the term gynoecium development suppressor-gene (GDS gene) or -allele as used herein refers to an allele having the sequence depicted in SEQ ID No: 1 or functional homologs or orthologs thereof. A preferred example of such a gene or -allele is the particular *Asparagus* DUF247 domain containing gene of which the cDNA is provided in SEQ ID NO:1. Accordingly, part of the invention are all nucleic acid sequences that are able to encode a protein that is an ortholog of or functional homologous with the amino acid sequence encoded by the nucleotide sequence of SEQ ID NO: 1

It has been shown herein that loss of function of this gene lifts the inhibition of gynoecium development. Loss of function or reduced function of the GDS gene is determined quantitatively by detecting that the number of berries and seeds produced on a plant is increased relative to plants of the same pedigree generation or previous generations of the pedigree to which said plant belongs. Such a loss of function will generally be caused by a mutation that is novel compared to previous generations of that pedigree. A mutant GDS gene or -allele as used herein may thus refer to any loss of function of the GDS gene that results in producing or contributing to the phenotypes of the invention One mutant is the GDS-deletion-insertion allele, obtained as a result from gamma irradiation treatment, described herein that has a deletion-insertion event starting at the 1820th nucleotide of ScaffoldMlocus4 (Genome version V1.1). that is inferred to cause the absence of coding information after the nucleotide 567 of SEQ ID NO:1 Another mutant, described herein, is the GDS-deletion-allele that has a thymine (single base pair)

deletion at the 3' end of the first exon of the GDS gene, which is a deletion of a thymine that corresponds to a deletion at position 527 of SEQ ID NO:1, which will lead to a reading frame shift.

Another mutation, described herein, is a GDS epi-allele which results from hypermethylation wherein said methylation covers the first predicted exon, the first predicted intron and partly overlaps the second predicted exon 2 of the GDS gene. Said methylation is notably (but not strictly) CHG methylation (spanning nucleic acids 309762-308323 of scaffold 905 (Genome version V1.1) or 1053-2492 or ScaffoldMlocus4 (Genome Version 1.1). The observed differential CHG methylation of the epi-allele, will overlap with SEQ ID NO:1 at nucleotides in the interval from the 5th to the −859th nucleotide. Yet another mutant, described herein (K57561 is a GDS gene allele that is characterized by a cytosine to an adenine change at position 684 of SEQ ID NO:1. that leads to a proline into a threonine amino-acid change (Pro→Thr)

Another mutation, described herein, is a GDS allele [K4381 that is characterized by cytosine to an adenine change at position 166 of SEQ ID NO:1.

Another mutation, described herein, is a GDS allele [K1150], resulting from gamma irradiation treatment, characterized by an adenine to guanine mutation at a position that corresponds to position 1193 in SEQ ID NO:1, which leads to an asparagine (N) to serine (S) amino acid change.

Another mutation described herein is a GDS allele [K1129.300-8] is an adenine to thymine change identical to nucleotide position 1160 of SEQ ID NO:3. This adenine to thymine change is separated by 665 nucleotides from the adenine of the first predicted start codon of the GDS gene Three similar mutations, described herein, are three independently obtained non-natural GDS null-alleles, where the GDS gene has been entirely deleted (in the present case as the result of gamma irradiation treatment) which was inferred from the loss of genetic marker alleles and sequences n.

The GDS gene is herein understood as a gene comprising a Domain of Unknown Function 247 in its protein sequence that may belong to a group of proteins which in dioecious asparagus species, represses pistil development and fruiting. Preferred examples of said GDS gene is the *Asparagus* DUF247 domain containing gene as described herein. However, the invention also comprises functional homologs and/or orthologs of this GDS gene.

Also used in the present specification is the term "dominant suppressor of gynoecium development". This term more clearly explains the function of the female suppressor GDS gene but for the remainder should he deemed to be identical to this term.

The female suppressor gene that suppresses gynoecium development may also be introduced in other plants, for instance to provide female sterility in in case fruit set is undesirable.

The dioecious plant of the invention is preferably of the genus *Asparagus*, more preferably of the species *Asparagus* officinalis. However, the invention is also contemplated for other dioecious plants such as the crops *Cannabis*, Dioscoreophyllum volkensii, *Humulus, Pistacia, Taxus* and Valerians.

*Asparagus* is a genus in the plant family Asparagaceae, subfamily Asparagoideae. It comprises up to 300 species. Most are evergreen long-lived perennial plants growing from the understory as lianas, bushes or climbing plants. The best-known species is the edible *Asparagus officinalis*, commonly referred to as just asparagus. It is the aim of the present invention to change the gender of an *Asparagus* plant or to cross and select an *Asparagus* plant belonging to the subgenus *Asparagus* (see Norup et al 2015 and the subgenus *Asparagus* clade in their FIG. 3) for species that usually are dioecious, such as but not limited to *A. aphyllus, A. stipularis, A. filicinus, A. schoberoides, A. kiusianus, A. oligoclonos, A. maritimus, A. inderiensis, A. officinalis*, or *A. cochinchinensis* or *A. prostratus* or are usually gynodioecius, such as but not limited to, *A. plocamoides, A. altissimus, A nesiotes* and *A acutifolius*. In case the text refers to asparagus or *Asparagus* plants or asparagus plants, at least all of the above *Asparagus* species or any asparagus plant belonging to the genus *Asparagus* to be used in breeding are included.

Nucleic acid sequences or fragments comprising suppressor of gynoecium development (GDS) genes and alleles and nucleic acid sequences or fragments comprising GDS genes and alleles may also be defined by their capability to "hybridise" with the GDS as described above, and more particularly the sequence provided in SEQ ID NO: 1 or SEQ ID NO:3 or splice variants of said gene, preferably under moderate, or more preferably under stringent hybridisation conditions. "Stringent hybridisation conditions" are herein defined as conditions that allow a nucleic acid sequence of at least about 25, preferably about 50 nucleotides, 75 or 100 and most preferably of about 200 or more nucleotides, to hybridise at a temperature of about 65° C. in a solution comprising about 1M salt, preferably 6×SSC or any other solution having a comparable ionic strength, and washing at 65° C. in a solution comprising about 0.1 M salt, or less, preferably 0,2×SSC or any other solution having a comparable ionic strength. Preferably, the hybridisation is performed overnight, i.e. at least for 10 hours and preferably washing is performed for at least one hour with at least two changes of the washing solution. These conditions will usually allow the specific hybridisation of sequences having about 90% or more sequence identity.

"Moderate hybridization conditions" are herein defined as conditions that allow a nucleic acid sequences of at least 50 nucleotides, preferably of about 200 or more nucleotides, to hybridise at, a temperature of about 45° C. in a solution comprising about 1 M salt, preferably 6×SSC or any other solution having a comparable ionic strength, and washing at room temperature in a solution comprising about 1M salt, preferably 6×SSC or any other solution having a comparable ionic strength. Preferably, the hybridisation is performed overnight, i.e. at least for 10 hours, and preferably washing is performed for at least one hour with at least two changes of the washing solution.

These conditions will usually allow the specific hybridisation of sequences having up to 50% sequence identity. The person skilled in the art will be able to modify these hybridisation conditions in order to specifically identify sequences varying in identity between 50% and 90%.

An important embodiment of the present invention is a method to improve breeding in dioecious plants comprising providing a plant in which the functional expression of the dominant suppressor of gynoecium development is disrupted or reduced and introducing said plant in [1] inbreeding, [2] backcross breeding or recurrent backcross breeding or [3] double haploid breeding techniques. As has been indicated in the background section, the breeding of dioecious plants is hampered because of limitations in the use of self-fertilization, backcrossing and seed propagation. Provision of a plant of the invention in which expression of the GDSgene is disrupted or hampered solves this problem, because it enables the development of a hermaphrodite or partly hermaphrodite plant, which can be used to generate a true-breeding parent line.

In a particular embodiment of the invention, 'the hermaphrodite trait' described in present invention is used in breeding of dioecious plants, more preferably *Asparagus* plants in order to create inbred lines.

Essentially, creating one or more inbred line(s) according to the present invention comprises the steps of:

[1] Creating a novel hermaphrodite plant in which the functional expression of the dominant suppressor of gynoecium development is disrupted or reduced, which results in plants having both a functional gynoecium of a plant and a functional androecium, hereafter also referred to as a plant that has a 'hermaphrodite trait'. How such a novel hermaphrodite plant in which the functional expression of the dominant suppressor of gynoecium development is disrupted or reduced can be created, is described further hereinbelow.

[2] Preparing a novel hermaphrodite plant by preparing a hybrid plant, comprising the 'hermaphrodite trait', by at least one cross in which a first plant comprising the 'hermaphrodite trait' is crossed with a second plant.

[3] Facilitating the self-fertilization of the plant obtained in step [1] or step [2], and selecting from the progeny thereof one or more preferred plant(s).

[4] Optionally repeating the step of self-fertilization of the plant(s) obtained in step [3] one or more times and selecting from the progeny thereof one or more preferred plant(s)

[5] Optionally changing the gender of a plant comprising the 'hermaphrodite trait' obtained in step [3] or [4] into a male plant by sufficiently restoring the function or expression of the dominant suppressor of gynoecium development In one particular embodiment of the invention said novel hermaphrodite plant of step [2] is created by a first plant comprising said 'hermaphrodite trait' with a second plant of female gender, and selecting from the progeny thereof plants comprising said 'hermaphrodite trait';

In another embodiment of the invention, said novel hermaphrodite plant of step [2] is created by crossing a first plant comprising said 'hermaphrodite trait' with a second plant comprising said 'hermaphrodite trait', and selecting from the progeny thereof a plant comprising said 'hermaphrodite trait'

In yet another embodiment of the invention said novel hermaphrodite plant of step [2] is created by crossing a first plant comprising said 'hermaphrodite trait' with a second plant of male gender that is not homozygous for the dominant suppressor of gynoecium development, and selecting from the progeny thereof a plant comprising said 'hermaphrodite trait'

In another embodiment of the invention, said novel hermaphrodite plant of step [2] is created by a first step (a) in which a first plant comprising said 'hermaphrodite trait' is crossed with a second plant of male gender that is homozygous or heterozygous for the dominant suppressor of female development, and selecting from the progeny thereof a male plant that will he able to transfer the 'hermaphrodite trait' to a next generation, followed by a second step (b) in which the male plant obtained in step (a) is crossed as a first plant with a second plant that is not homozygous for the dominant suppressor of gynoecium development, and selecting from the progeny thereof a plant comprising said 'hermaphrodite trait.

Related to this first embodiment, is the provision of a female plant of the invention in which expression of both the GDS and TDF1 genes are jointly disrupted or hampered. Such a plant can aid in solving this problem, because it enables crossing this particular female plant as pistillate parent with a plant from which said female plant was derived. but which plant still contains both the GDS and TDF1 genes. Such a cross then essentially is a cross that can be used to generate a true-breeding parent line. This possibility relating to the embodiment discussed above is mentioned to clarify that a plant in which the GDS gene is disrupted or hampered may enable the development of a hermaphrodite or partly hermaphrodite plant, but in particular cases extends to the development of a female plant.

In yet another embodiment of the invention the hermaphrodite trait is exploited in back-cross breeding. In particular the present invention provides a method for introducing a 'genetic trait' into the genetic background of a super-male plant, to provide an syngeneic super-male plant, where a super-male is defined as a plant that will not be able to provide female plants in its direct offspring by fertilizing a female plant. By the present invention super-male plants can be obtained that are highly syngeneic because of the ability to make direct crosses between a first degree relative of the super-male and the super-male itself. Accordingly, the present invention provides a method that allows a direct cross of a first-degree relative and its super-male parent to obtain offspring by said cross. This is achieved by providing a method, comprising the steps of:

[1] Preparing F1 hybrid plant progeny as a first step to introduce a 'genetic trait' (i.e. a trait of interest) into the genetic background of a super-male plant by crossing a first plant comprising said 'genetic trait' with a second plant, which is a super male, and selecting from the progeny thereof a plant that is capable to transfer the 'genetic trait' to a next generation The skilled person may appreciate that in step [1] a first plant that is able to transfer the 'genetic trait' into the genetic background of a super-male plant can be of any gender. However, in case said first plant is of male gender, either the first plant, or the second plant or both plants, thus at least a single plant, used in the cross of step [1] must be capable of seed production. Such a plant capable of seed production should be feminized. Either such a feminized plant is a 'male-to-hermaphrodite-transgender or 'male-to-andromonoecious transgender'. Such a plant thus may be the result of disrupting the function of the dominant suppressor of gynoecium development or reducing the expression of the dominant suppressor of gynoecium development or it is a male-to-female-transgender as the result of disrupting the function of the dominant suppressor of gynoecium development or reducing the expression of the dominant suppressor of gynoecium development of a plant in which also the stimulator of androecium development has been disrupted or reduced in its expression The skilled person will recognize that the present invention provides a method to make an F1 hybrid by crossing a male plant that is able to transfer a 'genetic trait' directly to a super-male plant, which hitherto has been impossible in the art, unless either the first plant or the second plant or both plants used in step [1] express natural hermaphroditism or andromonoecy that differs from the feminization according to the present invention. The skilled person will recognize that it is not necessary to specifically describe whether or not a plant is feminized-in step [1] as this first step described that 'progeny' must be obtained from which 'a plant, that is principally capable to transfer the 'genetic trait' to a next generation, can be selected'. However the skilled person will appreciate the ability, thus flexibility to use a male plant that is able to transfer the 'genetic trait' as first plant in step [1].

[2] The second step (BC1 or Back-Cross 1) is crossing the hybrid obtained in step [1] with a second plant that is the same or has a similar genotype as the super-male used in step [1], where either the first plant, or the second plant or both plants, thus at least a single plant of this crossing of step [2], is feminized as the result of disrupting the function of the dominant suppressor of gynoecium development or reducing the expression of the dominant suppressor of gynoecium development, preferably transiently, and selecting from the BC1 progeny thereof a plant that is principally capable to transfer the 'genetic trait' to a next generation, and has a functional androecium.

[3] Optionally repeating step [2] one or 'n' times to warrant that the hybrid obtained in step [2] is sufficiently syngeneic to the super-male plant first used in step [1] and selecting from the progeny thereof a BC2 or BCn plant that is principally capable to transfer the 'genetic trait' to a next generation and has a functional androecium.

[4] Optionally, and preferably transiently, disrupting the function of the dominant suppressor of gynoecium development or, preferably transiently, reducing the expression of the dominant suppressor of gynoecium development of a BC1 or BC2 or BCn (where BCn denotes higher generation backcrossing for n generations) plant obtained in step [1] or step [2] or step [3] to facilitate self-fertilization and select from the progeny thereof a plant that is homozygous for the 'genetic trait' and represents a super-male

[5] Optionally obtaining doubled haploids of plants obtained in step [1] or step [2] or step [3] to select a plant that is homozygous for the 'genetic trait' and represents a super-male.

[6] Optionally restoring the function or the expression of the dominant suppressor of gynoecium development of a plant obtained in step [2] or [3] or [4] in such a way that the 'hermaphrodite trait' of said plant is no longer transferred to a next generation, thus becomes a supermale, which is preferably homozygous for the 'genetic trait'.

The skilled person will appreciate that this step [6] will be necessary when in the pedigree of the plants obtained in [2], or [3] or [4] or even [5], a permanent, rather than transient, loss of function or permanent, rather than transient, reduced expression of the dominant suppressor of gynoecium development was introduced, that may allow the unwanted transfer of the 'hermaphrodite trait' to a next generation and thus has to be restored into the male trait (thus at a common of at least sufficient level of suppression of gynoecium development as in non-hermaphrodite or non-andromonoecious males).

The skilled person will appreciate that this method to apply a direct cross of a first-degree relative and its super-male parent to obtain offspring by said cross, hitherto has been impossible. For a conventional method of introducing a genetic trait into a super-male a hybrid can be made between a plant that has said 'genetic trait' by crossing a first plant comprising said 'genetic trait' with a second 'super-male' plant. However, the resulting hybrid will be male and can never be directly crossed in a following generation to the super-male recurrent parent. Instead it will take an additional cross of said hybrid to a female plant first before the next hybrid, resulting from this latter cross, that retained the 'genetic trait' as female parent can be crossed again to the super-male recurrent parent. In the method provided by the current invention a hybrid that has a first degree relationship with a super-male can always be directly crossed with a super-male in the following generation as this super-male or said hybrid or both plant will be a 'transgender male-to-hermaphrodite' or a 'transgender male-to andromonoecous' or a transgender 'male- or andromonoecous-to-female', which comprises the feminized trait.

An exception to the rule that a direct cross of a first-degree relative and its super-male parent to obtain offspring by said cross will be impossible could be provided when either the fist-degree relative or the super-male parent comprises 'natural hermaphroditism or andromonoecy'. Such 'natural hermaphroditism or andromonoeicy' is not the result of disruption or reduced expression of the dominant suppressor of gynoecium development but the result of naturally occurring unknown, non-Gynoecium development suppressor GDS, 'modifying genes' such as have been speculated upon in the art as was illustrated in the literature outlined in the previous paragraphs and thus differs from the 'hermaphrodite trait' as a tool to create syngeneic super-males provided by the present invention.

The manipulation of the GDS gene, which is responsible for expressing the female suppresser, i.e. the suppressor of gynoecium development, can be achieved in various manners. The GDS gene is represented by the hypothesized cDNA of the gene (SEQ ID NO:1):

```
ATGTCTGAAGCCTGGGTTTCTCGATTGACATCGGATATAGGGTGGCTCAA
TAGCACAAATGCCCTGATGGCGGAGGCCTGGAGTCGTCATTCAATCTACG
ACGTACCAGACACATTCAAAAGGATTAGCCCACAGATCCATAAGCCATCA
ACGTGCAGCATTGGACCACGGTACAATGGAGATCTGAATCTCCTTCGTAT
GGAACGTCATAAACACAGGGCGCTACTGAACTTCCTCATCCGATGTCAAG
TGTCGATCCATGACATCATACGAGCCCTGAGGAAGAACCTGCACGATTTC
AGAGCCTGCTATCAAGATCTTGACACCTTTTGGATGAAGAATGATGATGA
GTTCCTAAAAATCATGATTTACGATGGGGCTTTCATGATTGAAATCATGA
TAGCGACCGTTGAACCATATGAGCGCACACCTTCTAGCTATCATGCCAAG
GACCCAATATTCAAGAAGCCATACTTGGTCGAAGATCTTCGTGTAGATAT
GCTCAGGTTGGATAATCAAATTCCAATGAAGGTCCTGGAGATATTGTCTA
AATTCTGCAAGAACAAGATCCAAAGCATTCATCAGCTGATCAGACATTTC
TTCTTCCGCAAATATGAAGAGGGAAGATATGATATTAGCCAAACCTCTAC
GATATTTCACCTACCCGAGATAACAGGGCATCACCTACTGGATGTGTACA
AAAAAACTCTTATACAGCATGGAGGTTATCATCACACCAGCAGTCGCCAA
CCACTATCGGCAGTTGAACTACAGGAGGCGGGCGTAATTTTCCAGTGCAG
TGAAACGCTGTCATTGACAGATATATGCTTCACCAAAGGTGTCCTTTGCC
TACCTGCAGTCGACGTTGACGAAGCATTTGAAGTTGTTATGCGGAATCTC
ATTGCCTATGAGCAAGCACATGGCGAAGGTCAAGAGGTAACATCCTATGT
GTTTTTTATGGATGGCATTGTAAACAATGACAAAGATATTGCCTTGCTTC
GAGAGAAGGGTATTATCAGGTCGGGGGTAAGCAGTGATAAGAGGATAGCC
GATCTTTTTAATGGACTGACAAAAGGTATAGTTGCAAAAGTTGTCGACAA
TGTTGATGTTGATGTAACCAAGGACATCAATGAGTATTGCAATAGAAGAT
GGAACAGGTGGCAAGCCAACTTTAAGCAGAGATACTTTGCGAATCCATGG
GCCTTTCCCGGGATTCATAAATGTTGATCTCAACGGTAGGGTTTCGTGCT
GGGGTTTGAGTATCTGTGGAGCATTTAGTGTGAGAAAACTGTGCTTAATT
TCGCTTCTCCACTATGAGAGTGGAGGAGCACAACTAATGGTATCCAGTGT
```

-continued

```
AAATTTAACTCTTTGTTTGTGGCTTGAGAACAACATGTTCTTTATATAGC

CTTTGACAATGTAATAGATAACATCAACTTCTTTGATACATACTAGCGAT

ATTAGCATCCAAAAAAAAAA
```

This cDNA translates to the following protein (SEQ ID NO: 2):

```
MSEAWVSRLTSDIGWLNSTNALMAEAWSRHSIYDVPDTFKRISPQIHKPS

TCSIGPRYNGDLNLLRMERHKHRALLNFLIRCQVSIHDIIRALRKNLHDF

RACYQDLDTFWMKNDDEFLKIMIYDGAFMIEIMIATVEPYERTPSSYHAK

DPIFKKPYLVEDLRVDMLRLDNQIPMKVLEILSKFCKNKIQSIHQLIRHF

FFRKYEEGRYDISQTSTIFHLPEITGHHLLDVYKKTLIQHGGYHHTSSRQ

PLSAVELQEAGVIFQCSETLSLTDICFTKGVLCLPAVDVDEAFEVVMRNL

IAYEQAHGEGQEVTSYVFFMDGIVNNDKDIALLREKGIIRSGVSSDKRIA

DLFNGLTKGIVAKVVDNVDVDVTKDINEYCNRRWNRWQANFKQRYFANPW

AFPGIHKC
```

Alternatively, and depending on the way the genomic sequence is analyzed the cDNA of the gene is represented by 5 other gene sequences, as listed in FIG. 3. These sequences are also identified in the present application as "splice variants" or "splicing variants" or homologous *Asparagus* sequences (such as M4 and 3098, see Example 1) of SEQ ID NO: 1. It should further be indicated that these sequences are derived from the genomic sequences that have been listed in FIG. 13

The term "GDS gene" as used in the present application is considered to comprise all splice variants (including SEQID NO: 1) and all genomic sequences (including introns) that may be derived from the genomic sequences of FIG. 13, that encode a functional female suppressor or encode an homologous/orthologous gene. Any genetic constructs targeting this gene or mRNA that is transcribed thereof are preferably targeted to exon 1, exon 2 (or exon 3) or the DUF247 domain. With respect to the DUF domain, no exact consensus can be given. According to the EMBL-EBI definition of the DUF247 family, the domain is characterized by the following database sequences, which are used as seed for building the family definition:

#=GS Q9SJR2_ARATH/47-434 AC Q9SJR2.1
#=GS Y3720_ARATH/48-447 AC Q9SD53.1
#=GS Q8L703_ARATH/63-464 AC Q8L703.1
#=GS Q9FK84_ARATH/46-474 AC Q9FK84.1
#=GS Q9FK85_ARATH/33-422 AC Q9FK85.1
#=GS Q01J11_ORYSA/116-543 AC Q01J11.1
#=GS Q9SNE9_ARATH/180-572 AC Q9SNE9.1
#=GS Q5XVA4_ARATH/115-523 AC Q5XVA4.1
#=GS Q9SN03_ARATH/92-493 AC Q9SN03.1
#=GS A0MF17_ARATH/106-485 AC A0MF17.1
#=GS A0MF16_ARATH/141-548 AC A0MF16.1
#=GS Q6ZC88_ORYSJ/184-584 AC Q6ZC88.1
#=GS Q0ISB3_ORYSJ/59-439 AC Q0ISB3.1
#=GS Q2QQW6_ORYSJ/36-452 AC Q2QQW6.1
#=GS Q2QQW3_ORYSJ/44-442 AC Q2QQW3.1
#=GS Q2R303_ORYSJ/44-473 AC Q2R303.1
#=GS Q1RU73_MEDTR/31-462 AC Q1RU73.1
#=GS Q6YPE9_ORYSJ/42-450 AC Q6YPE9.1
#=GS Q6YRM8_ORYSJ/34-376 AC Q6YRM8.1
#=GS 022159_ARATH/86-487 AC 022159.2

#=GS Q5S4X4_ARATH/111-507 AC Q5S4X4.1
#=GS Q6E287_ARATH/8-398 AC Q6E287.1
#=GS Q8VYN0_ARATH/16-440 AC Q8VYN0.1
#=GS Q1ZY19_BETVU/30-415 AC Q1ZY19.1
#=GS 049393_ARATH/295-669 AC 049393.2
#=GS Q9LFM8_ARATH/35-411 AC Q9LFM8.1
#=GS Q65XU3_ORYSJ/66-531 AC Q65XU3.1
#=GS Q65XU0_ORYSJ/49-551 AC Q65XU0.1
#=GS Q65XT8_ORYSJ/62-514 AC Q65XT8.1
#=GS Q9FP37_ORYSJ/53-496 AC Q9FP37.1
#=GS Q6ZKD8 ORYSJ/79-483 AC Q6ZKD8.1
#=GS Q69TN1_ORYSJ/150-572 AC Q69TN1.1
#=GS Q7XDW8_ORYSJ/117-510 AC Q7XDW8.1
#=GS Q0J689 ORYSJ/12-411 AC Q0J689.2
#=GS Q0J2S9_ORYSJ/46-452 AC Q0J2S9.1
#=GS Q0J2T1_ORYSJ/42-479 AC Q0J2T1.1
#=GS Q651E4_ORYSJ/52-471 AC Q651E4.1
#=GS Q2QPY1_ORYSJ/9-413 AC Q2QPY1.1
#=GS Q2QPX9 ORYSJ/148-562 AC Q2QPX9.1
#=GS Q656Q9 ORYSJ/57-451 AC Q656Q9.1
#=GS Q94D69_ORYSJ/72-478 AC Q94D69.1
#=GS Q94D66_ORYSJ/18-428 AC Q94D66.1
#=GS Q6ET10_ORYSJ/21-420 AC Q6ET10.1
#=GS Q8LJD1_ORYSJ/36-407 AC Q8LJD1.1
#=GS Q60E19_ORYSJ/30-431 AC Q60E19.1
#=GS Q10RD5_ORYSJ/49-462 AC Q10RD5.1
#=GS Q6H4T3_ORYSJ/102-533 AC Q6H4T3.1
#=GS Q6K301_ORYSJ/128-542 AC Q6K301.1

As has already be mentioned above, various mutants have been produced that provide suppression of gynoecium development through a change in the coding sequence or expression of the GDS gene. In a first embodiment the interference with the female suppressor target gene consists of preventing transcription thereof. This can be achieved for instance by means of RNA oligonucleotides, DNA oligonucleotides or RNAi molecules directed against the target gene promoter.

Inhibition of the above mentioned gene expression is preferably accomplished by providing a plant with a construct which is able to express an inhibiting compound. Inhibition of gene expression refers to the absence (or observable decrease) in the level of protein and/or mRNA product from the female suppressor target gene. Specificity of inhibition refers to the ability to inhibit the female suppressor target gene without manifest effects on other genes of the cell. The consequences of inhibition can be confirmed by examination of outward properties of the cell or the organism (in the specific case of the invention, the sexual phenotype) or by biochemical techniques such as RNA solution hybridisation, nuclease protection, Northern hybridisation, reverse transcription, gene expression monitoring with a microarray, antibody binding, enzyme linked immunosorbent assay (ELISA), Western blotting, radioimmunoassay (RIA), other immunoassays, and fluorescence activated cell analysis (FACS). Basically, four methods for inhibition are known at this moment and included in this application: antisense expression, sense co-suppression, RNA-inhibition (RN Ai) and CRISPR-Cas or CRISPR-Cpf mediated gene silencing. However, the invention is not limited to these methods and any other method which causes silencing of the endogenous female suppressor gene is included.

For antisense expression, the nucleotide sequence of the female suppressor gene, or at least a part thereof of 19 nucleotides, usually at least 21-nucleotides or more: more preferably the GDS region, is put behind a constitutive or sexual organ specific promoter in anti-sense direction. After transcription of this nucleotide sequence an mRNA is produced which is complementary to the mRNA formed through transcription of the endogenous female suppressor gene. It is well proven by now that production of such an anti-sense mRNA is capable of inhibition of the endogenous expression of the gene for which it is complementary. Furthermore, it has been proven that to achieve this effect even sequences with a less than 100% homology are useful. Also antisense mRNA's which are shorter than the endogenous mRNA which they should inhibit can be used. Generally, it is accepted that mRNA sequences of 23 nucleotides or more which have an identity of 70% or more will be capable of generating an inhibitory effect. The principal patent reference is EP 240,208 of Calgene Inc. There is no reason to doubt the operability of antisense technology. It is well-established, used routinely in laboratories around the world and products in which it is used are on the market.

The second approach is commonly called sense co-suppression. This phenomenon occurs when the female suppressor gene or part of said gene is expressed in its sense direction. Although this kind of expression when full length genes are used most often results in overexpression of the gene, it has been found that in some cases and especially in cases when a sequence shorter than the full length sequence is used, expression of this gene or fragment causes inhibition of the endogenous gene. The principal patent reference on sense co-suppression is EP 465,572 in the name of DNA Plant Technology Inc.

Sense and antisense gene regulation is reviewed by Bird and Ray (Gen. Eng. Reviews 9: 207.221, 1991). Gene silencing can thus be obtained by inserting into the genome of a target organism an extra copy of the target female suppressor gene coding sequence which may comprise either the whole or part or be a truncated sequence and may be in sense or in antisense orientation. Additionally, intron sequences which are obtainable from the genomic gene sequence may be used in the construction of suppression vectors. There have also been reports of gene silencing being achieved within organisms of both the transgene and the endogenous gene where the only sequence identity is within the promoter regions.

The third possible way to silence genes is by using the so-called RNAi technology, which covers all applications in which double-stranded RNAs are used to achieve silencing of an endogenous gene. As has been demonstrated by Fire et al. (Nature, 391: 806.811, 1998) application of a dsRNA of which one strand is at least partly complementary to the endogenously produced mRNA whether produced intracellularly or added extracellularly is extremely capable of inhibiting translation of the mRNA into a protein. It is believed that this phenomenon works through the intermediate production of short stretches of dsRNA (with a length of 23 nucleotides). To achieve production of dsRNA a construct is made harbouring both a sense and an antisense nucleotide sequence (together also called an inverted repeat) of at least 19, usually 23 nucleotides or more, of which one is complementary to the endogenous gene which needs to he silenced. The sense and antisense nucleotide sequences can be connected through a spacer nucleotide sequence of any length which allows for a fold back of the formed RNA so that a double stranded RNA is formed by the sense and antisense sequence. The spacer then serves to form the hairpin loop connecting both sense and antisense sequence. The order of the sense and antisense sequence is not important. It is also possible to combine more than one sense-antisense combination in one and the same construct. If the simple form is depicted as: prom—S—spac—AS—term, also the following constructs can be applied: prom—S1—spac—AS1—spac—S2—spac—AS2—term, or prom—S2—spac—S1—spac—AS1—spac—AS2—term. Variations in the built up of the construct are possible, as long as the end product of the transcription of said constructs yields one or more dsRNAs. Alternatively, the double stranded structure may be formed by two separate constructs coding for complementary RNA strands, where RNA duplex formation occurs in the cell. In short notation these constructs then look like: prom1-S1-term1 and prom2-AS1-term2. Prom1 and prom2 can be the same or different but should both be constitutive or fruit-specific promoters, term 1 and term2 can be the same or different. Both constructs can be introduced into the cell on the same vector, but can also be introduced using two different vectors.

RNA containing nucleotide sequences identical to a portion of the target female suppressor gene are preferred for inhibition. RNA sequences with insertions, deletions and single point mutations relative to the target sequence have also been found effective for inhibition.

Thus, sequences with a sequence identity of less than 100% may be used. Sequence identity may be calculated by sequence comparison and alignment algorithms known in the art (see Gribskov and Devereux, Sequence Analysis Primer, Stockton Press, 1991, and references cited therein), for instance by using the Smith-Waterman algorithm as implemented in the BESTFIT software program using default parameters (e.g. University of Wisconsin Computing Group). Thus, the duplex region of the RNA may be defined functionally as a (double stranded) nucleotide sequence that is capable of hybridising with a portion of the target gene transcript (e.g., 400 mM NaCl, 40 mM PIPES pH 6.4, 1 mM EDTA, 50° C. to 65° C. hybridization for 12-16 hours; followed by washing). The length of the identical nucleotide sequences should be at least 23 nucleotides, but preferably larger: 40, 50, 100, 200, 300 or 400 bases.

As disclosed herein, 100% sequence identity between the inhibiting construct and the target endogenous gene is not required to practice the present invention. Thus the invention has the advantage of being able to tolerate sequence variations that might be expected due to genetic mutation, strain polymorphism or evolutionary divergence.

Thus also included in the invention are constructs having a nucleotide sequence under control of a sexual organ-specific promoter, wherein said nucleotide sequence comprises a part of 19 r more nucleotides in a sense direction, or in an antisense direction or in an inverted repeat form, of the sequence of SEQ ID NO:1 or sequences that: are more than 70%, preferably more than 80%, more than 90%, more than 95% or more than 98% identical therewith.

The recombinant DNA constructs for use in the methods according to the present invention may be constructed using recombinant DNA technology well known to persons skilled in the art. The recombinant gene constructs may be inserted into vectors, which may be commercially available, suitable for transforming into plants and suitable for expression of the gene product in the transformed cells. Preferably used are binary vectors which are useful for plant transformation using *Agrobacterium.*

Alternatively, transcription is prevented by means of the expression of a negatively acting transcription factor acting on the target gene promoter. Such negatively acting transcription factor can be natural or artificial. Artificial negatively acting transcription factors can be employed by the overexpression of an engineered polydactyl zinc-finger transcription factor coupled to a general transcription repressor. According to a further embodiment, the interfering with the target gene consists of destabilizing the target gene mRNA, in particular' by means of nucleic acid molecules that are complementary to the target gene mRNA selected from the group consisting of antisense RNA, RNAi molecules. Virus Induced Gene Silencing (VIGS) molecules, co-suppressor molecules, RNA oligonucleotides or DNA oligonucleotides. In another embodiment the interfering with the target gene consists of inhibiting the target gene expression product. This can be achieved by means of the expression product(s) of one or more dominant negative nucleic acid constructs, overexpression of one or more suppressors which interact with the target gene product, or by means of one or more chemical compounds. A novel way to introduce site-specific alterations in transcription of an (eukaryotic) gene is by a variation in the recently described CRISPR-Cas genetic engineering, homologous recombination system. (Cong L et al. Science 2013; 339: 819-823; *Mali* P et al. Science 2013; 339: 823-826: Cho S W et al. Nat Biotechnol 2013; 31: 230-232; Jinek M et al. Elife 2013; 2: e00471). This variation entails the use of a Cas enzyme that is defective in endonuclease activity, but which retains its ability, when co-expressed with a gRNA, to specifically interfere with transcriptional elongation, RNA polymerase binding or transcription factor binding. This system is also indicated as CRISPRi. (Qi L S et al. Cell 2013; 152: 1173-1183; Larson, M H et al 2013, *Nature Protocols* 8:2180.2196; Amelio, I. and Melino G., 2015, *Cell Death & Differentiation;* 22: 3.5)

The above-described systems are all systems that act on expression and do not change the underlying genetic sequence of the gene. In that respect these systems are also relatively easy to switch on or switch off at moments when suppression of expression is needed or when suppression of expression is no longer needed. Such a switch can e.g. advantageously be effected by putting the expression of one or all of the components of the silencing system under control of a specific time- or location-restrained promoter. Such a promoter can be a promoter that is only expressed during a particular stage of the development of the plant or in a specific organ of the pant. Examples for these are promoters of genes that are specifically expressed during e.g. flower setting or in plant reproductive organs. In another embodiment inducible promoters may be used. Systems for introducing inducible expression in plants are commonly known (e.g. Borghi L 2010, *Methods Mol Biol.* 655:65-75) In these systems addition of an exogenic factor, e.g. a chemical compound such as alcohol or dexamethasone, may trigger start or disruption of expression.

Next to changes in the expression of the gene, the gene itself may be changed in such a way that no longer a functional protein is expressed. This may be achieved by mutating the gene. The one or more mutations can be introduced randomly by means of one or more chemical compounds and/or physical means and/or by insertion of genetic elements. Suitable chemical compounds are ethyl methanesulfonate, nitrosomethylurea, hydroxylamine, proflavine, N-methyl-N-nitrosoguanidine, N-ethyl-N-nitrosourea, N-methyl-N-nitro" nitrosoguanidine, diethyl sulfate, ethylene imine, sodium azide, formaline, urethane, phenol and ethylene oxide, Physical means that can be used comprise UV-irradiation, fast-neutron exposures X-rays and gamma irradiation. The genetic element is a transposon, T-DNA, or retroviral element.

More efficient and targeted techniques are provided for by so-called site-directed mutagenesis techniques. Many systems for site-directed mutagenesis (SDM) are known to the skilled person, the most notorious being nuclease based SDM systems such as zinc finger nucleases, transcription activator-like effector nucleases (TALENs), and LAGLI-DADG homing endonucleases (Curtin, S. J. et al., 2012, The Plant Genome 5:42-50). Another technology for SDM is based on homologous recombination with the target gene. The oldest is the Cre-Lox system, that has been extensively described. Already some time ago models have been presented by Bundock et al. (WO02/052026) and Prokopishyn et al. (WO03/062425). Very recently, the above discussed CRISPR-Cas system has been proven very effective for SDM based on homologous recombination in plants (WO2014/144155).

As has been stated in the introduction, the skilled breeder (especially of dioecious plants, more particularly of asparagus) would also be interested in enabling androecium development in plants. Enabling androecium development in a female plant to essentially change the gender, would allow to obtain seeds from an originally female plant in the absence of cross pollination (thus by self-fertilizaton) and would provide the ability to obtain doubled haploids by in vitro androgenesis from such a plant. Androecium development or inhibition of androecium development can be induced by modulating the expression of a gene producing a dominant male stimulator.

This dominant male stimulator (also indicated as stimulator of androecium development or stimulator of anther development) is a protein that is encoded by a gene that is identical to or a homologue or orthologue of the TDF1 (defective in Tapetal Development and Function) gene, which is found in *Arabidopsis* AT3G28470 and in rice (osTDF1, LOC_Os03g18480). Preferably, the protein with this function, is encoded by the TDF1 ortholog from *Asparagus officinalis* as depicted in SEQ ID NO:5.

A functional homolog of the nucleic acid sequence is herein defined as a nucleic acid sequence that has a high sequence identity with the sequence encoding the amino acid sequence depicted in SEQ ID NO: 5 and preferably having an high sequence identity with the nucleotide sequence of SEQ ID NO: 4 and which is expected to be able, when expressed in a dioecious plant which does not bear anthers, to induce anther formation.

From a sequence comparison of these sequences with the sequences of *Arabidopsis* and rice it appears that the so-called R2 and R3 domains of the protein are the domains that provide the functionality that is needed for the present invention. Thus, any protein sequence that comprises the R2 and R3 domains of the TDF1 gene and/or any nucleotide sequence encoding such a protein sequence, which sequence would be functional when expressed in a dioecious plant is encompassed in the present invention. Especially preferred are sequences that comprise the R2 and R3 domains of the *Asparagus officinalis* TDF1 gene as depicted in SEQ ID NO: 5, which lie in the first 125 amino acids sequence of the protein. Preferably said 112 and R3 domains are to be found from about aa 14—aa 57 (R2) and from about aa 70 to about aa 112 (R3)

Methods for using these nucleotide and/or amino acid sequences in breeding of dioecious plants, preferably asparagus, have been discussed above.

A further embodiment of the present invention is a method to detect if the plant has the property that is expected from the treatment. If the treatment consisted in reducing the expression of the dominant gynoecium development suppression gene, it, should be investigated whether the plant has become (more) feminized. This can be done by assessing the phenotype, i.e. waiting for the plant to be mature and checking whether phenotypical characteristics of feminization appear. However, a faster and more reliable method is using GDS marker assisted selection. In case GDS marker assisted selection has identified a mutation that may cause loss of function of the GDS gene, the introduction of said mutation may be guided by GDS marker assisted selection in further generations or the by molecular biological checks such as using markers that are sufficiently genetically linked to the mutation in the GDS gene, preferably at a genetic distance to the GDS gene of less than 50cM, more preferably, less than 40cM, more preferably less than 30cM, more preferably less than 20cM, more preferably less than 10cM, more preferably less than 5cM, more preferably less than 2cM more preferably less than 1cM to the M-locus to allow indirect. As will be established in the examples, the presence of one or two markers such as AO022, Asp1-T7, Asp2-Sp6, Asp4-Sp6, T35R54-1600seq, Asp80, Asp 432/448, Asp446,0 10A3_forward marker and 10B6_forward marker or CE64/CE66-HRM may give away which genotype is present and hence which phenotype will result from it. Next to the markers that are used in the experimental part of the present invention, it is also possible to use the genetic information of SEQ NO: 1 or SEQ NO: 3 to derive any markers or to develop molecular based assays for determining the genetic make-up of the plant. Further, alternatively, markers may be derived from the M-locus_scaffold4 sequence, or Scaffold 905 which are presented in FIG. 13.

In general, for selecting and crossing a plant in a method according to the invention a marker is used to assist selection in at least one selection step. It is known in the art that markers, indicative for a certain trait or condition, can be found in vivo and in vitro at different biological levels. For example, markers can be found at peptide level or at gene level. At gene level, a marker can be detected at RNA level or DNA level. Preferably, in the present invention the presence of such a marker is detected at DNA level, using the above described markers. Alternatively, a change in expression of the GDS gene can be assessed in plant parts by performing an immunoassay with an antibody that specifically binds the protein. Also primers such as described in Table 3 hereinbelow, can be used to amplify the GDS gene, of which the presence can be tested by a probe that binds with the sequence of this gene, e.g. a sequence derived from SEQ ID NO: 1. Further, use can also be made of specific markers that are to be found in the vicinity of the coding sequence, such as the markers that have been used in the experimental section of the present application. In case of transgenic approaches selecting a transformed plant may be accomplished by using a selectable marker or a reporter gene as discussed below.

In some cases it may be advisable to perform a method of the present invention through transient expression. Transient gene expression, as is e.g. achieved through agro-infiltration, is a fast, flexible and reproducible approach to high-level expression of useful proteins. In plants, recombinant, strains of *Agrobacterium tumefaciens* can be used for transient expression of genes that have been inserted into the T-DNA region of the bacterial Ti plasmid. A bacterial culture is infiltrated into leaves, and upon T-DNA transfer, there is ectopic expression of the gene of interest in the plant cells. However, the utility of the system is limited because the ectopic RNA expression ceases after 2-3 days. It is shown that post-transcriptional gene silencing (PTGS) is a major cause for this lack of efficiency. A system based on co-expression of a viral-encoded suppressor of gene silencing, the p19 protein of tomato bushy stunt virus (TBSV), prevents the onset of PTGS in the infiltrated tissues and allows high level of transient expression. Expression of a range of proteins was enhanced 50-fold or more in the presence of p19 so that protein purification could be achieved from as little as 100 mg of infiltrated leaf material. Although it is clear that the use of p19 has advantages, an agro-infiltration without p19 can also be used to test the functionality of candidate fragments and functional homologues, e.g. fragments and homologues that are used in RNAi constructs and/or CRISPR-Cas constructs.

In a particular embodiment of the invention it is preferred to restore the disrupted or reduced expression of the dominant suppressor of gynoecium development. Such a method could be provided by CRISPR-CAS as has been shown for plants (Jiang et al., 2013) in which is was demonstrated that the disrupted GFP protein could be restored by CRISPR-Cas.

Further, the invention comprises a method to improve breeding in dioecious plants comprising providing a plant in which the functional expression of the dominant male stimulator is restored and introducing said plant in inbreeding, backcross breeding, recurrent backcross breeding or double haploid breeding techniques. Such a restoration of the functional expression may be accomplished by complementation with a functional copy of this dominant male stimulator.

In an alternative embodiment, the present invention comprises a method for self-fertilisation of dioecious plants wherein one or both of the parent plants is a plant in which the lack of functional expression of the dominant male stimulator is complemented by a functional copy of said dominant male stimulator. When female plants are provided with a functional copy of the male dominant stimulator, said plants will become more mascular and thus will produce anthers, and thus these plants may be considered to be a hermaphrodite. As has been argued above, such a hermaphrodite plant may be used in several ways in the methods of the invention.

Since a plant which is provided with a functional dominant male stimulator is producing anthers, the present invention is also directed to a method for n vitro androgenesis comprising providing a plant with a gene that is able to produce such a functional protein. In order to produce such a plant all methods for providing a plant or plant cell with either a nucleic acid construct coding for the protein or the protein itself can be used. Such methdos have been described briefly above and are well known to the person skilled in the art.

There are multiple ways in which a (recombinant) nucleic acid can he transferred to a plant cell, for example *Agrobacterium* mediated transformation. However, besides by *Agrobacterium* infection, there are other means to effectively deliver of DNA to recipient plant cells when one wishes to practice the invention. Suitable methods for delivering DNA to plant cells are believed to include virtually any method by which DNA can be introduced into a cell, such as by direct, delivery of DNA such as by PEG-mediated transformation of protoplasts, by desiccation/inhibition-mediated DNA uptake (Potrykus et al., Mol. Gen. Genet., 199:183-188, 1985), by electroporation (U.S. Pat. No. 5,384,253), by agitation with silicon carbide fibers (Kaeppler et al., 1990; U.S. Pat. Nos. 5,302,523; and 5,464,765), and by acceleration of DNA coated particles (U.S. Pat. Nos. 5,550,318; 5,538,877; and 5,538,880). Through the application of techniques such as these, cells from virtually any plant species may be stably transformed, and these cells may be developed further into transgenic plants.

In case *Agrobacterium* mediated transfer is used, it is preferred to use a substantially virulent *Agrobacterium* host cell such as *A. tumefaciens*, as exemplified by strain A281 or a strain derived thereof or another virulent strain available in the art. These *Agrobacterium* strains carry a DNA region originating from the virulence region of the Ti plasmid pTiBo542 containing the virB, virC and virG genes. The virulence (vir) gene products of *A. tumefaciens* coordinate the processing of the T-DNA and its transfer into plant cells. Vir gene expression is controlled by virA and virG, whereby virA upon perception of an inducing signal activates virG by phosphorylation. VirG, in turn, induces the expression of virB,C,D,E. These genes code for proteins involved in the transfer of DNA. The enhanced virulence of pTiBo542 is thought to be caused by a hypervirulent virG gene on this Ti plasmid (Chen et al. Mol. Gen. Genet 230: 302-309, 1991).

After transfer of a nucleic acid into a plant or plant cell, it must be determined which plants or plant cells have been provided with said nucleic acid. This may be done using molecular assaying techniques, such as sequence alignment with molecular markers or PCR-based techniques, but it may also for example be accomplished by using a selectable marker or a reporter gene. Among the selective markers or selection genes that are most widely used in plant transformation are the bacterial neomycin phosphotransferase genes (nptI, nptII and nptIII genes) conferring resistance to the selective agent, kanamycin, suggested in EP131623 and the bacterial aphIV gene suggested in EP186425 conferring resistance to hygromycin. EP 275957 discloses the use of an acetyl transferase gene from *Streptomyces viridochromogenes* that confers resistance to the herbicide phosphinothricin. Plant genes conferring relative resistance to the herbicide glyphosate are suggested in EP218571. The resistance is based on the expression of a gene encoding 5-enolshikimate-3-phosphate synthase (EPSPS) that is relatively tolerant to N-phosphomethylglycine. Certain amino acids such as lysine, threonine, or the lysine derivative amino ethyl cysteine (AEC) and tryptophan analogs like 5-methyl tryptophan can also be used as selective agents due to their ability to inhibit cell growth when applied at high concentration. In this selection system expression of the selectable marker gene results in overproduction of amino acids by transgenic cells which permits the transgenic to grow under selection. Suitable examples of reporter genes are beta-glucuronidase (GUS), beta-galactosidase, luciferase and green fluorescent protein (GFP). However, preferably a marker-free approach, such as disclosed in WO 03/010319, is used, where the presence of the resistance gene(s) can be assayed with nucleotide sequence based assays.

Next to methods for introducing the (gene encoding for) the dominant male stimulator, the expression of this protein may also be inhibited as has been discussed above. Inhibition of gene expression or disruption of the gene may be accomplished using the techniques as identified above for inhibition of the dominant suppressor of gynoecium development. As discussed above, inhibition of the dominant male stimulator, in addition to the inactivation of the female suppressor, should provide a female plant derived from a male or andromonoecious plants which is included as an example of a desirable feminized plant. Besides, inhibition of the dominant male stimulator might be useful in crosses where emasculation is required to provide an alternative for emasculation.

The invention is further illustrated in the following, non-limiting examples.

Example 1

Genetic Analysis of Hermaphrodite Mutant 5375

Following anther culture of a heterozygous male (XY), Riccardi et al. (2010) obtained male (YY), female (XX) and the "5375" genotype, a rare example of a completely hermaphroditic clone. This genotype for which all flowers are hermaphrodite is distinct from andromonoecious genotypes that have varying proportions of male and hermaphroditic flowers. The completely hermaphroditic clone as mature plant showed the ability to produce berries from all of its flowers, during vigorous growth in three successive seasons which was a unprecedented high fruit set compared the fruit set of all male breeding stock ever evaluated by the institute of CRA-ORL, Lodi, Italy. The hybrid plant that served as source material used to obtain hermaphrodite 5375 was a male plant not capable of producing berries, and in case berries have been overlooked in some seasons it would only be few because source plants for anther culture, used in breeding preferably show very limited berry set.

In garden asparagus, two dominant alleles at two linked genes (A, F) have been hypothesized to control androecium development and repression of gynoecium development, respectively (Bracale et al., 1990, Sex Plant Reprod. 3:23.30; Bracale et al., 1991, Plant Sci 80:67-77).

In this model cited by Riccardi et al. (2010), females have the 'aaff' genotype, heterozygous males have the 'AaFf' genotype, and super males have the 'AAFF' genotype. Riccardi et al (2010) speculated that a recombination event within the M locus of "5375" has produced a doubled haploid and a totally hermaphroditic plant with an AAff genotype. To test this hypothesis, several crosses were planned that were both phenotyped with respect to flowering (to be classified as either female, male or hermaphrodite) and analyzed for sex linked markers. By using a set of highly variable single locus microsatellite markers it was later demonstrated that the particular hermaphrodite '5375' was not a doubled haploid but in fact is highly heterozygous. The assumption was made that hermaphrodite '5375' represents a soma clone of a hybrid that donated the anthers used for tissue culture, rather than a doubled haploid originating from a pollen gamete in which a rare recombination took place. As a result the genotype 'Aaff' was considered to be more appropriate. Under this model, this genotype retained its heterozygosity for the dominant androecium development gene 'Aa' as observed in normal males and it further carries two recessive alleles 'ff' of the dominant gynoecium development repressor gene because a loss of function mutation disrupted the gynoecium development suppressor gene that was originally present in the heterozygous male that has donated the particular anther. In a scheme: AaFf (mutation) →Aaff To test co-segregation of the hermaphrodite traits with the sex chromosome or 'M-locus', sex linked markers have been used. The first marker was a proprietary microsatellite marker, designated AO022, that is derived from GenBank accession CV287860 which has the following sequence (SEQ ID NO: 13):

GGCTCTTCTGGTTGGGATCAGTCATCGACTCAGCAAACTCAGCAAACTAC

TCCTGCAACTGGTTATGATTACTACAACCAGCAGCAGCAGCAGCAGCAGC

AGCCACCAACATCAGCCCCAGCTGATAACACCAGCGCCTACAATTATTCC

CAGCCTCATCCTGGTTATAGCTCTCAAGGTTCTTATACTGCTCAGCAGCC

AACTTATGGTCAGGAAAACTATGCTGCTCCTGGTTATAACACTCAAACTC

CCCAAACTGGTTATGATCAATCATACAATTCTGCACCTGCTTATGCTGGA

GCTACCTCCACCAACCCCACTCAAGATGGATCTGCTGCATCCAATCAACC

-continued

```
ACCAAGCAGTGCTCCTGCTAGTTACCCCCCACAACCTGTGTACGGTGCAC

CTGCACCATTAACCCAACCCGGTTATGGACAGTCTCCTCAATCCCAGAAG

CCACCGGCAACTCCGCCAGCTTATGCTCAAACAGGATATGGTACAAATAC

TGGATATGGTACACAGTACCAGCAGGTTCAGCCATATGGTGGGGGCCCAC

CAGCTGGCCAGGGAGGGTACGGTCAGCAGCAAGCATATGGTGATTCTTAC

GGCAGTGGTGGGTATTCCCAGCCACCGGCGTATGGGAGTGAGGGTGGTGC

AGCTCCGGCGGCTCCTGGTGCAGTGACCAAGGCTTCTCCTCAGAGTTAGA

CGTGATGTATGGTAAGTTTTTGATGCGGTAGTTTTGCTTTAACACTTAGA

TTCCGGTAGAAGTTTAGATGTTGTAGTCTTGTGTTTTGCTCTGATTTGGT

TTTGAATTTAGTAATGGTTTGTTAAGCTTTGTTGTTTCTGCGTGGGTGGA

AATTCTGTATGTTTTCAAATTTGA
```

This marker has been previously tested in breeding and research populations and always mapped at a genetic distance, varying from zero to five centi-Morgan from the M-locus. The second marker was Asp1-T7 published by Jamsari et al (2004), which has the sequence:

```
GAGTCGACCTGCGGGCATGCAAGCTTGGCGTGAATACGTTGCTGNGGATT

CTCAATATGCGAGGCATTTGGAAGCACCAAAATCCGCACCCTACCGAGTA

CCCAAATCAAACACTTTCCATGGTGCCTTTCCACTATCTTCCTCACAATG

TAATCTTCTAGTGAAATAAATGCAGTTACCTCTGTTGAGAGAGTGGATAG

CCTTCTCATCAAAGAGCTAGCAGTGTTCACCTACCCCCGTGCTACAATGT

TCACCTACCCCCTGCTACAGTGTTCACCTGTCCCAAATAGTGTTCACCTG

CCCCCATGAGAAAATTTATAAATATCCCCCTAAGTTTGATTTGTAAGGTA

TCTCATTAGCAGAGAGAGAAAGAGAAAGATACAGATATAAGTGATATCAT

TGAGAGGTCTTGAGAGAGAGTTTGTAAGAATTCTTGGAGAGTATATTGAA

CAAGAGAGGGGGGTCTCTTTTATCTTTATTTTTGTACCTCGAAAGGGATA

TAAAGGAATT
```

To find evidence for the hypothetical 'Aaff' genotype, several test crosses were made. In the first pedigree, designated pedigree 1E, Hermaphrodite 5375 (Aaff) was allowed to self-fertilize. The resulting so called 'S1' or 'F2', progeny of pedigree 1E comprised both hermaphrodites, females and no male plants. Flowers of this progeny were analyzed and fruit set (in insect free conditions) was recorded. The observed number of hermaphrodites and females was 166 and 56 respectively, which follows a 3:1 ratio that is expected for a monogenic dominant gene conferring hermaphroditism. All hermaphrodites in the progeny set berries under insect free conditions. It is important to note that all flowers of stalks of mature hermaphrodite plants derived from 5375 set fruit, thus produce berries, and that all berries contained black colored fully developed seeds. Such well developed seeds are comparable to which are commonly observed in female plants Marker analysis of the hermaphrodite parental plant 5375 disclosed its 161/169 genotype for marker AO022, where 161 and 169 refer to estimated fragment sizes in a capillary electrophoresis system. The estimated fragment sizes may vary per capillary system but can be clearly distinguished from each other by the skilled person. Further, the hermaphrodite 5375 shows the presence of PCR marker Asp1-T7. It appears that the observed hermaphrodite trait is tightly linked to the AO022 microsatellite marker locus. The AO022.169 allele is found in 163 out of 166 hermaphrodite plants, whereas this allele is lacking in 53 of 58 female plants. All plants of this population were tested for the Asp 1-T7 male marker. All 166 hermaphrodites tested had the Asp1-T7male marker allele, whereas all 65 females tested lacked the Asp 1-T7 male marker allele. The results for a subset of the pedigree 1E plants are summarized in Table 1a.

TABLE 1a

Pedigree 1E. Result obtained for flower phenotypes and marker segregation of the progeny resulting from self-fertilization of hermaphrodite 5375 that has a 161/169 genotype for marker AO022 and shows the Asp 1-T7 male diagnostic fragment when used as template DNA

| | AO022 microsatellite genotype | | | |
|---|---|---|---|---|
| (161/169) self fertilized | 161/169 | 169/169 | 161/161 | |
| female | 3 | 0 | 55 | 58 |
| hermaphrodite | 120 | 43 | 1 | 164 |
| hermaphrodite (Asp1-T7 pres) self fertilized | Asp1-T7-male allele present | Asp1-T7-male allele absent | | |
| female | 0 | 18 | | 18 |
| hermaphrodite | 57 | 0 | | 57 |

One can conclude that, with a few exceptions for the microsatellite marker that must result from recombination events, plants that lack the AO022-169 allele (161/161 genotypes) and lack the dominant Asp1-T7 male marker allele also lack anthers and thus are female. As a result it can be speculated that the gynoecium suppressor has been lost in hermaphrodite 5375 (which then allows stigma development and fruit set) whereas the ability to produce anthers has been retained in heterozygous condition that segregates in this cross and is linked to the genetic markers provided. In a second generation, twenty-six F3 families obtained from self-fertilization of 26 F2 plants that had the 161/169 genotype for marker AO022 which is indicative of a Aaff genotype, were further phenotyped. Those family progenies varied in size between 4 and 89 individuals per family. In all but three of these F3 families, again segregation was observed for hermaphrodites and females for a total number of 589 versus 193, respectively. This again is a 3:1 ratio expected for a dominant gene conferring hermaphroditism where a dominant gene for androecium development segregates in a genetic background where the gynoecium development suppressor must be absent. In the other three (161/169-F2 plant derived) F3 families comprising eighty, twelve or eleven individuals only hermaphrodites were found thus no females. It is likely that for this particular plant a recombination event, has occurred between the microsatellite marker and the sex determination genes and that this particular self-fertilized plant, despite of its 161/169 genotype had the AAff genotype. Of the largest family, ten plants were tested for the presence of the Asp 1-T7 fragment and indeed none of these plants lacked the male Asp1-T7 allele. Another fourteen F3 families, varying in progeny size between 8 and 88, that were derived from self-fertilized F2 plants which had the 169/169 genotype for marker AO022, indicative for a AAff genotype, produced a grand total of 324 hermaphrodite siblings and no female plants. The results of the pedigree 1E F3 crosses are shown in Table 2.

TABLE 2

Table showing the AO022 microsatellite alleles and Asp-1_T7 marker results and plant phenotype of F2 families plus the segregation for flower (and spontaneous berry set) phenotype as females (F) and/or hermaphrodites (H) in F3 families obtained for those individual F2 plants. An 'M' indicated for marker AspT7-106 refers to the presence of a PCR fragment diagnostic for the male specific region.
Cross 1 (5375 self = F2 plants)

| pseudo F2 plants) | | | | | | |
|---|---|---|---|---|---|---|
| sample (plant | AspT7- | | | | Pseudo F3 plants Phenotype | |
| n) | 106 | Phenot. | AO022_1 | AO022_2 | F | H |
| 1 | M | H | 161 | 169 | 4 | 8 |
| 5 | M | H | 161 | 169 | 5 | 13 |
| 8 | M | H | 161 | 169 | 10 | 20 |
| 9 | M | H | 161 | 169 | 18 | 69 |
| 13 | M | H | 161 | 169 | 13 | 76 |
| 24 | M | H | 161 | 169 | 9 | 19 |
| 26 | M | H | 161 | 169 | 3 | 3 |
| 36 | M | H | 161 | 169 | 2 | 8 |
| 37 | M | H | 161 | 169 | 0 | 80 |
| 44 | M | H | 161 | 169 | 23 | 68 |
| 53 | M | H | 161 | 169 | 21 | 32 |
| 57 | M | H | 161 | 169 | 5 | 13 |
| 66 | M | H | 161 | 169 | 3 | 1 |
| 70 | M | H | 161 | 169 | 3 | 12 |
| 75 | M | H | 161 | 169 | 3 | 12 |
| 84 | M | H | 161 | 169 | 8 | 20 |
| 85 | M | H | 161 | 169 | 9 | 43 |
| 87 | M | H | 161 | 169 | 1 | 12 |
| 90 | M | H | 161 | 169 | 28 | 62 |
| 95 | M | H | 161 | 169 | 4 | 12 |
| 99 | M | H | 161 | 169 | 1 | 20 |
| 140 | M | H | 161 | 169 | 7 | 23 |
| 141 | M | H | 161 | 169 | 0 | 11 |
| 169 | M | H | 161 | 169 | 8 | 37 |
| 193 | M | H | 161 | 169 | 5 | 6 |
| 200 | M | H | 161 | 169 | 0 | 12 |
| 34 | M | H | 169 | 169 | 0 | 8 |
| 43 | M | H | 169 | 169 | 0 | 13 |
| 7 | M | H | 169 | 169 | 0 | 14 |
| 42 | M | H | 169 | 169 | 0 | 15 |
| 114 | M | H | 169 | 169 | 0 | 16 |
| 96 | M | H | 169 | 169 | 0 | 17 |
| 88 | M | H | 169 | 169 | 0 | 21 |
| 4 | M | H | 169 | 169 | 0 | 22 |
| 6 | M | H | 169 | 169 | 0 | 23 |
| 86 | M | H | 169 | 169 | 0 | 24 |
| 71 | M | H | 169 | 169 | 0 | 88 |
| 61 | M | H | 169 | 169 | 0 | 21 |
| 62 | M | H | 169 | 169 | 0 | 21 |
| 82 | M | H | 169 | 169 | 0 | 22 |

In a second pedigree designated pedigree 2E, the female double haploid '5459' was crossed to hermaphrodite '5375'. In the previously proposed genetic model this is: 5495×5375=aaff×Aaff. For microsatellite marker AO022, plants 5495 and 5375, respectively showed the 166/166 and 161/169 genotype. The progeny of this test cross 2E showed 64 hermaphrodites and 83 female plants and no male plants. This does not differ significantly from a 1:1 segregation ratio, which is consistent with a segregating dominant gene for anther development. Further this population shows the entire absence of gynoecium development suppression that does not segregate in this progeny which suggests, or at least does not reject, that 5375 effectively is homozygous for the loss of function of the gynoecium repressor gene. The segregation of phenotypic classes and markers are shown in Table 1b. The marker results show that, as already was observed in cross 1E, that the AO022-169 allele is closely linked to the hermaphrodite flower trait. The AO022.169 allele was present in 60 out of 64 hermaphrodites whereas this allele is absent for 82 out of 83 female plants. A subset of plants (11 hermaphrodites and 10 females) tested for Asp1 T7 show full linkage of the male allele and the hermaphrodite trait.

TABLE 1b

Pedigree 2E. Result obtained for flower phenotype and marker segregation in the progeny of the cross: female 5459 × hermaphrodite 5375 that respectively have the AO022 genotypes 166/166 and 161/169 and for which only 5375 shows the diagnostic male Asp1-T7 fragment that is absent in the female parent.:

| female (166/166) × hermaphrodite (161/169) | 166/169 | 161/166 | |
|---|---|---|---|
| female | 1 | 82 | 83 |
| hermaphrodite | 60 | 4 | 64 |
| female (Asp1T-7 abs)) × hermaphrodite (Asp1-T7 pres) | Asp1-T7-male allele present | Asp1-T7-male allele absent | |
| female | 0 | 10 | 10 |
| hermaphrodite | 11 | 0 | 11 |

In a third pedigree, designated pedigree 3E, the hermaphrodite plant '5375' was emasculated and crossed to double haploid super male '1770'. For this cross, twelve F1 plants were obtained. All of the twelve plants of two expected different genotypes 'AaFf' and 'AAFf', were male and thus were incapable to produce fruits and seeds. This indicates that the male trait; the repression of gynoecium development is dominant over the hermaphrodite trait. It is thus established that the hermaphrodite trait; i.e. the ability of a plant, that has functional anthers, to produce an androecium and fruits with seeds, is recessive. Evidence that the small number of plants indeed comprised both genotypes 'AaFf' and 'AAFf', thus that indeed the 'Af gamete' (typical for the hermaphrodite) and not only the 'af' gamete (that can be obtained from common females and heterozygous males) contributed to the generation of this progeny follows from marker analysis. Doubled haploid 1770 had a 166/166 marker genotype for marker AO022. The phenotypic results and the micro satellite marker results are shown in Table 1c. Seven F1 plants showed the AO022 microsatellite marker 161/166 genotype. Because of the genetic linkage between microsatellite AO022 allele '161' and the female phenotype (confirmed in pedigrees 1E and 2E) those plants, or at least the vast majority of those plants, must have resulted from a maternal gamete of hermaphrodite 5375 that has the female chromosome genotype 'af' and a paternal gamete of doubled haploid super male 1770 that is 'AF'. As a result those plants are likely to have the 'AaFf' genotype. The remaining five plants had the AO022 microsatellite marker genotype 169/166 and because of linkage between the microsatellite AO022 allele '169' and the hermaphrodite phenotype those plants, or at least the vast majority thereof, must have resulted from a maternal gamete of hermaphrodite 5375 carrying the male chromosome causing the hermaphrodite trait in alleles: 'Af' and a paternal 'AF' gamete of doubled haploid super male 1770. As a result those plants are likely to have the 'AAFf' genotype. It is thus established that the hermaphrodite trait, i.e. the ability of a plant that has functional anthers to produce an androecium and fruits with seeds, is recessive. The plants were tested for marker Asp 1-T7 and all plants showed the male allele of this male specific marker.

TABLE 1c

Pedigree 3E. Result obtained for flower phenotypes and marker segregation for F1 cross 5375 × (5375 × 1770) in which the F1 plant with genotype 169/166 was used to pollinate emasculated 5375:

| 5375 (161/169) × 1770 (169/166) | 169/166 | 161/166 | |
|---|---|---|---|
| hermaphrodite | 0 | 0 | 0 |
| male | 5 | 7 | 12 |

TABLE 1d

Pedigree 3E. Result obtained for flower phenotypes and marker segregation of pseudo test cross 1800 × selected F1 (5375 × 1770) which for their markers corresponds to 1800 (166/166) × selected F1 (169/166):

| 1800 (166/166) × selected F1 (169/166) | 169/166 | 166/166 | |
|---|---|---|---|
| hermaphrodite | 11 | 1 | 12 |
| male | 0 | 12 | 12 |

TABLE 1e

Pedigree 3E. Result obtained for flower phenotypes and marker segregation of pseudo test cross 1800 × selected F1 (5375 × 1770) which for their markers corresponds to1800 (HRM curve 'T deletion') × selected F1 (HRM melting curve WT):

| 1800 ( ) × selected F1 (T deletion/WT sequence) | DUF247 T deletion | DUF247 WT sequence | |
|---|---|---|---|
| hermaphrodite | 12 | 0 | 12 |
| male | 0 | 12 | 12 |

In a next generation for pedigree 3E, a pseudo test cross was made. A single male plant derived from the cross 5375×1770 was selected for its AO022 marker genotype 169/166 that, because of linkage between the marker and sex determination genes, almost certainly will have the genotype AAFf. This selected plant was crossed to a doubled haploid female plant '1800' that had the 166/166 genotype for marker AO022. In formula: 1800× selected F1(5375×1770)=166/166×169/166=aaff×AAFf. This family segregated for 121 males versus 118 hermaphrodites consistent with a 1:1 ratio expected for the segregation of the dominant gynoecium development suppressor Ff versus ff. It is also consistent with the genetic model that predicts that all siblings will be heterozygous 'Aa' for the androecium development gene and thus all have anthers. For a subset of twenty-four plants of this pseudo testcross, the AO022 microsatellite genotypes was determined. The results are shown in Table 1d. Eleven of twelve hermaphrodites had a 166/169 genotype. One hermaphrodite, a possible recombinant between the 166 allele and the gynoecium development repressor gene, had a 166/166 genotype. All twelve male plants had a 166/166 genotype. This confirms linkage between the AO022 microsatellite paternal marker allele '166' (originating from the male grandfather 1770) and the gynoecium development repressor. It further indicates that the absence of the gynoecium development repressor allele, linked to the AO022 169 paternal allele of the hermaphrodite grandparent, allows gynoecium development.

All of the above crosses teach that the segregation observed is consistent with an 'Aaff' genotype for hermaphrodite clone 5375 that is heterozygous for the androecium development gene as in common males but lacks a functional allele of the gynoecium development repressor gene. The recessively inherited hermaphroditism is linked to the sex chromosome of asparagus and the genetic analysis presented here, provides for a method in which the genetic linkage between the trait and markers on the sex chromosome can be tested or verified. It is obvious to the skilled person that other markers can be used for testing the linkage of the hermaphrodite trait to the sex chromosome as well.

The results of the crosses further teach that the hermaphrodite is able to self-fertilize and provides offspring in further generations, which causes inbreeding. Inbreeding in this example can be inferred form analysis of the AO022 genotypes. For instance, for pedigree 1E the heterozygosity at the AO022 locus is reduced by 50%. It is conceivable by any geneticist or breeder that this kind of inbreeding can reduce heterozygosity at any other locus. Further it will be clear to the skilled person that compared to full-sib mating the inbreeding by self-fertilization which is presented here occurs more efficiently. In full-sib mating, like the subsequent crossing of sisters and brothers, it takes three times more generations to achieve a similar decrease in heterozygosity compared to self-fertilization (Bos, 1985. Thevenin, 1967; p108). It is further conceivable that one can easily get rid of the hermaphrodite trait in a particular inbreeding generation by selecting against the androecium development gene (e.g. by using linked markers) to finally obtain inbred female plants that will not pass the hermaphrodite trait to a next generation in case this is no longer desired (e.g. in a commercial F1 hybrid). Therefore, a method is provided to obtain inbred lines by self-fertilization that does not depend on autosomal modifiers enabling self-fertilization (for those modifiers see Franken, 1969, 1970). Instead, the inbreeding in the present invention relies on the selection for a recessive allele that allows gynoecium development linked to a dominant gene 'Af' that allows androecium development followed by later selection against this allelic combination 'Af' of two linked genes to obtain common female inbred lines.

Because there is co-segregation of the hermaphrodite trait and marker Asp1-T7 that is indicative for a chromosome segment unique to male plants, the previously proposed theory of Riccardi et al (2010) that a recombination event has 'replaced' the gynoecium repressor located on a male specific chromosome segment for a female chromosome segment that naturally lacks a gynoecium repressor was rejected. Instead, it was hypothesized that a mutation has taken place in the gynoecium repressor on the male chromosome segment that is still present in the hermaphrodite plant and has not been lost by recombination. This mutation can be transmitted to a next generation and shows Mendelian single locus segregation.

As a result efforts were aimed at finding a gene in which a mutation has occurred.

The laboratory of Dr. James H Leebens-Mack (University of Georgia at Athens, USA) has worked on a draft genome sequence of doubled haploid super male DH00/086 (version 1.0) in collaboration with the Beijing Genomics Institute at Shenzhen, China (BGI).

For this, genomic DNA (gDNA) isolated from spear or fern tissue of DH00/086 was isolated and pooled for Illumina HiSeq sequencing. Briefly, the pooled gDNA was prepared for shot gun library preparation by strict fragmentation and end repair of gDNA, adapter ligation, size selection, PCR amplification, library purification and Quality Control. A total of 9 short-insert paired end libraries and 6 long-insert paired end libraries (Mate pair) were used for Next Generation Sequencing (NGS); 21 flow channels were prepared and the libraries were sequenced in Hiseq2500

2×100nt, paired-end mode. The data was collected and filtered according to Quality scores in Illumina pipeline 1.8. A total of 163 Gigabase of sequence passed the Quality criteria corresponding to approximately 123× coverage of the haploid genome of *Asparagus officinalis*. The De Novo assembly of was conducted in the SOAPdenov2 pipeline with a multiple k-mer strategy (Luo et al., 2012, Peng et al, 2012). SOAPdenovo2, as with SOAPdenovo, is made up of six modules that handle read error correction, de Bruijn graph (DBG) construction, contig assembly, paired-end reads mapping, scaffold construction, and gap closure. The de novo assembly has 24,113 scaffolds with prefix ScafSeq-, of which 115 were pseudoscaffolds made up of alignment of genomic sequences which most likely map to the M-locus and surrounding regions. The pseudoscaffolds have the prefix M-locus_scaffold-. The genomic sequences used for alignment included Bacterial Artificial Chromosome (BAC) contig sequences derived from two BAC-libraries constructed from High Molecular Weight genomic DNA of the genotypes DH00/086 (supermale) and DH00/94 (female) (Leebens-Mack, J H, personal communication 2010). The libraries were screened with molecular markers genetically coupled to M-locus phenotypes and the BAC DNA of candidate clones was subsequently sequenced using Illumina TruSeq cluster chemistry for the Genome Analyzer Hx system. One useful statistic of De Novo assemblies such as the 24,113 scaffolds-containing assembly of *Asparagus officinalis* is the N50 value. Briefly, contig or scaffold N50 is a median statistic such that 50% of the entire assembly is contained in contigs or scaffolds equal or larger than this value. The resulting of assembly of the data of *Asparagus officinalis* exhibited a contig N50 of 21,179 and scaffold N50 of 301,040 representing 80% of its haploid genome. The consensus sequences of the scaffolds were used for annotation purposes such as putative repetitive elements and ab initio gene prediction and served as Reference Genome in both cDNA read mapping experiments, referred to as RNA-Seq experiments and genomic re-sequencing experiments of several genotypes of *Asparagus officinalis*. The Reference Genome used is referred to as *Asparagus* Genome Scaffold V1.10 (AGS V1.10) the annotation metadata were stored as individual files in AGS V1.10 based relational databases.

A number of methods were used to screen AGS V1.10 for all known classes of repetitive elements as well as newly found predictions of repetitive elements including plant transposon elements. LTRharvest is a software package that computes boundary positions of Long Terminal Repeat retrotransposons in genomic sequences (Ellinghaus et al., 2008). LTRharvest was used in default and manually set similarity indices and output files included predictions in FASTA format and GFF3 format. Repeat Explorer is a python script software suite that includes utilities for characterization of repetitive sequences and transposable element coding sequences in NGS data (Novak et al 2010). Next to the command line versions RepeatExplorer is accessible on a Galaxy-based web server: www.repeatexplorer.org (Novak et al., 2013). RepeatMasker is a program that screens DNA sequences for interspersed repeats and low complexity sequences. RepeatMasker (Institute for Systems Biology, Seattle, Wash.) is a set of BLAST-based programs that aligns input query sequences to curated databases of repetitive elements and output files include a masked query sequence in which the nucleotides of predicted repetitive elements are replaced by the symbol N. The query AGS V1.10 was masked using RM13last at default sensitivity. The masked output file (nnAGS V1.10) was used for ab initio gene prediction. Basically, the programs use trained sets of algorithms to collect evidence for genes by identifying candidate signal sites such as promoter, translational start, termination, splice donor, splice branch and splice acceptor sites, suggested by given sources of gene evidence. Ab initio gene prediction was performed using BGI pipelines (Fgenesh and GlimmerHMM) in default settings resulting in combined GLEAN files for gene evidence (Elsik, 2007). The set comprised 28,288 predicted protein-coding genes with an average CDS length of 1006 bp and on average 4.75 exons per predicted transcript. In addition, the SNAP (Semi-HMM-based Nucleic Acid Parser, Korf, 2004) software package with Viridiplantae settings was used to predict gene models. A total of 24,116 genes were predicted by the SNAP algorithms.

RNAseq

Two RNA-Seq experiments were performed. The first experiment was designed to identify differentially expressed transcripts between female, male, and supermale *Asparagus* genotypes and subsequently map these transcripts to the AGSV1.10 genome assembly. In total, 13 Limgroup asparagus lines, namely 9Female (9F), 9Male (9M), 88F, 88M, 88superMale (88supM). 89F, 89M, 89supM, 103F, 103M, 103supM and the male DH lines DH00/86 and DN3389 were processed (Limgroup BV, Horst, The Netherlands). Briefly, total RNA was isolated from flower buds using RNeasy Plant Mini Kit protocols (Qiagen GmbH, Hilden Germany) and RNA quality was assessed with Agilent RNA Bioanalyzer protocols (Agilent, Santa Clara, Calif.). The RNA was converted into double-stranded cDNA and prepared for Illumina NGS shot gun library preparation by adapter ligation, size selection, PCR amplification, library purification and Quality Control. A total of 13 short-insert paired end libraries were used for NGS; 3 flow channels were prepared and the libraries were sequenced in Hiseq2500 2×100nt paired-end mode. The data was collected and filtered according to Quality scores in Illumina pipeline 1.8. A total of 500 Million reads passed the Quality criteria. De novo transcriptome assembly was conducted in the Trinity software package (Grabher et al., 2013). Trinity combines three independent software modules: Inchworm, Chrysalis, and Butterfly, applied sequentially to process large volumes of RNA-seq reads. Trinity partitions the sequence data into many individual De Bruijn Graphs, each representing the transcriptional complexity at a given gene or locus, and then processes each graph independently to extract full-length splicing isoforms and separate transcripts derived from paralogous genes. After normalization of the paired end reads, 276,556 sequences were assembled with a total length of 378 Mb and N50 of 2386. The 13 paired end read data sets were mapped back on the De novo assembly and data for the genotypes was compared to call for gender specific expressed Single Nucleotide Polymorphisms (eSNPs) and short insertion/deletions (indels) using the software package vcftools (variant call format, Wellcome Trust Sanger Institue, Cambridge, UK). A number of stringency settings was performed and reviewed. It was concluded that no strict gender specific eSNPs or indels could be called for further validation. The RNA-Seq data was also used to address differential expression of genes in the aforementioned 11 LimGroup samples using the Cufflinks software package version Cufflinks 2.2.1 (Trapnell et al., 2010).

Cufflinks assembles transcripts, estimates their abundances, and tests for differential expression and regulation in RNA-Seq samples. It accepts aligned RNA-Seq reads and assembles the alignments into a set of transcripts. Cufflinks then estimates the relative abundances of these transcripts based on how many reads support each one. Briefly, the RNA-Seq data was aligned to the Reference AGS V1.10 using TopHat 2.0.13 (Kim et al., 2013) with default stringency settings. TopHat aligned the RNA Seq reads to the rmAGS V1.10 Reference and analyzes the mapping results to identify splice junctions between the exons. The data was processed in Cufflinks using the Cuffdif2 algorithm (Trapnell et al., 2012) to identify and quantify differentially expressed transcripts. Comparison of the expression revealed a pattern both between the lines and the genders in general. Cluster analysis of expression patterns showed that three clusters appear, related clusters for the 88 and 89 genotypes and a third cluster having the 9 and 103 genotypes expression patterns. The comparison of Male versus Female expression for all genotypes shows that 269 genes were significantly upregulated in the Male samples and 2 downregulated. The comparison of Supermale versus Female expression for all genotypes shows that 434 genes were upregulated and 49 downregulated. A number of genes involved in anther development were found to he differentially expressed in Supermales versus Females including the genes orthologous to genes for ABORTED MICROSPORES AMS' and MALE STERILITY MS2 annotated in *Arabidopsis thaliana*. A list of at least 40 genes showed no expression in Female samples.

The second RNA-Seq experiment was designed to study whole genome gene expression in flower buds obtained from different genotypes of *Asparagus* of particular developmental stages. The genotypes and their related samples selected for RNASeq analysis were the following: DH Male 1770=sample 1; DH Female 1800=sample 2; Herma 5375=sample 3; plants AAff Herma of Pedigree 1E=Bulk 1 and 4 plants AaFf Males of pedigree 3E=Bulk 2. From each plant, three flower button stages were sampled: A) premeiosis (1.0-1.2 mm long for Herma and Male, 0.8-1.0 mm for Female); B) uni-nucleated microspores (1.6-1.8 mm), or just developed ovary (1.2-1.4 mm); C) fully developed carpels (just before sepal opening). Briefly, total RNA was isolated from flower buds using a NucleoSpin RNA Plant Kit (Macherey-Nagel GmbH & Co. Duren, Germany)) and RNA quality was assessed with Agilent RNA Bioanalyzer protocols (Agilent, Santa Clara, Calif.). The RNA was converted into double-stranded cDNA and prepared for Illumina NGS shot gun library preparation by adapter ligation, size selection, PCR amplification, library purification and Quality Control. A total of 13 short-insert paired end libraries were used for NGS; 2 flow channels were prepaired and the libraries were sequenced in Hiseq1000 2×100nt paired-end mode. The data was collected and filtered according to Quality scores in Illumina pipeline 1.7. The RNA-Seq data was aligned to the Reference AGS V1.10 using TopHat 2.0.13 (Kim et al., 2014) with sensitive stringency settings (—b2-very-sensitive) and a large maximum intron size (40 kb). TopHat annotation data were stored as metadata to AGS V1.10 and loaded as individual tracks in the Integrated Genomics Viewer (IGV, Robinson et al., 2011). In IGV, genomic scaffolds of AGS V1.10 can be inspected individually.

The laboratory of Dr. Leebens-Mack also applied AUGUSTUS Gene Prediction (Hoff et al., 2013) and EVM (Evidence Modeler, Haas et al., 2008) to aggregate gene model predictions from multiple sources. AUGUSTUS gene prediction involves two subsequent steps: creating a training set for *Asparagus* and the actual gene prediction. The training software automatically generates gene sets from genomic sequences and the set of Trinity assemblies and subsequently trains AUGUSTUS parameters for a new species. These new parameters and the supplied extrinsic evidence are applied in the gene prediction modules. EVM was used to integrate all gDNA and RNA-Seq data available. The software combines ab initio gene predictions and transcript alignments into weighted consensus gene structures. For *Asparagus*, this included the GLEAN, SNAP, Trinity, Cufflinks and AUGUSTUS data sets. The highest weight was given to the Cufflinks data and the lowest weight to the GLEAN data. A total of 24kGene Models was annotated. The gene prediction metadata were stored as individual files in AGS V1.10 based relational databases.

Re-sequencing includes mapping or alignment of reads to the Reference and error correction. For this, short-insert paired end Illumina HiSeq sequencing data (BGI, Shenzhen, China Shenzhen, China Shenzhen, China) were obtained of the *Asparagus officinalis* genotype DH00/094. DH00/094 is a female doubled haploid obtained by tissue culture from the same hybrid from which DH00/086 originates. The data included 100nt paired end reads representing approximately 40× genomic coverage. The reads of both DH00/086 and DH00/094 were aligned to the Reference genome using the Burrows-Wheeler Aligner in the software package bwa-MEM with default settings (Li and Durban, 2009) as well as the more recently developed ultrafast short-read aligner included in the software package Bowtie2 (Langmead et al., 2012). The DH00/094 mapping was used to call for gender specific SNPs and short indels using the software package vcftools (variant call format, Wellcome Trust Sanger Institue, Cambridge, UK). A number of stringency settings was performed and reviewed. Initially, SNPs were found in at least 3,195 gene Models. The re-sequencing metadata were stored as individual files in AGS V1.10 based relational databases. All metadata to AGS V1.10 including the aforementioned LTR-harvest data, gene predictions, Trinity RNA-Seq assemblies, Cufflinks annotations and re-sequencing data were stored as individual tracks in the genome browser JBrowse 1.11.4 (Generic Model Organism Database project GMOD, 2013). Tracks can be vizualized for all genomic scaffolds of AGS V1.10 individually.

Markers

All available genetic and molecular data of genomic sequences known to be related to the M-locus in *Asparagus officinalis* were used as query sequences in local alignment searches (BLAT, BLAST, Althschul et al., 1990) in a blast database of the reference genome scaffolds AGS V1.10. The searches were performed in default settings. These molecular sequences included published genetic markers closely linked to the M-locus designated Asp1-T7, Asp2-Sp6, Asp4-Sp6 (Jamsari et al., 2004), T35R54.1600seq (Kanno et al., 2013) and genetic markers developed by Limgroup designated Asp80, Asp432/448, Asp446, 10A3_forward marker and 10B6_forward marker. Asp1-T7 (510 nt) has 98.37% Identity to scaffold905 at position 305206-304717 and related pseudomolecule M-locus_scaffold4 (ML4) at position 5470-5959. Asp2-Sp6 (634nt) has 98.85% Identity to scaffold905 at position 307405-306883 and ML4 at position 3271-3793 and 96% Identity to scaffold199 at position 464878-464359. Asp4-Sp6 (443 nt) has 96.62% Identity to scaffold997 at position 224027-224469 and shows high Identities (>80%) to a further 303 genomic scaffolds. The sequence of Asp-Sp6 was annotated as LTR-retrotransposon, subclass Ty1-copia related. The sequence T35R54 (1586 nt) is part of a highly repetitive region in the genome of *Asparagus* and has 100% identity to 25 genomic scaffolds, among which ML4 at position 22173-21039. Asp80 aligns to scaffold1194, Asp432/448 to scaffold206 and Asp446 to scaffold 1539. The sequences of 10A3_forward marker and 10B6_forward marker align with 100% Identity to scaffold997 and related pseudomolecule M-locus_scaffold2. Since three of closely linked sequences align to a small region in scaffold905 and ML4, these scaffolds were prioritized as subjects to further study. EVM data show fifteen (15) Gene Models in scaffold905 (351847 bp) and three (3) Gene models in ML4 (94405 bp). Two (2) EVM annotations are in close vicinity to the positions of the marker sequences Asp 1-T7, Asp2-Sp6 and T35R54: evm_1.TU.M-locus_scaffold4.1 (type: mRNA, 189 bp) and EVM_1 prediction M-locus_scaffold4.2 (Type: Gene 2640 bp).

Figure 2:
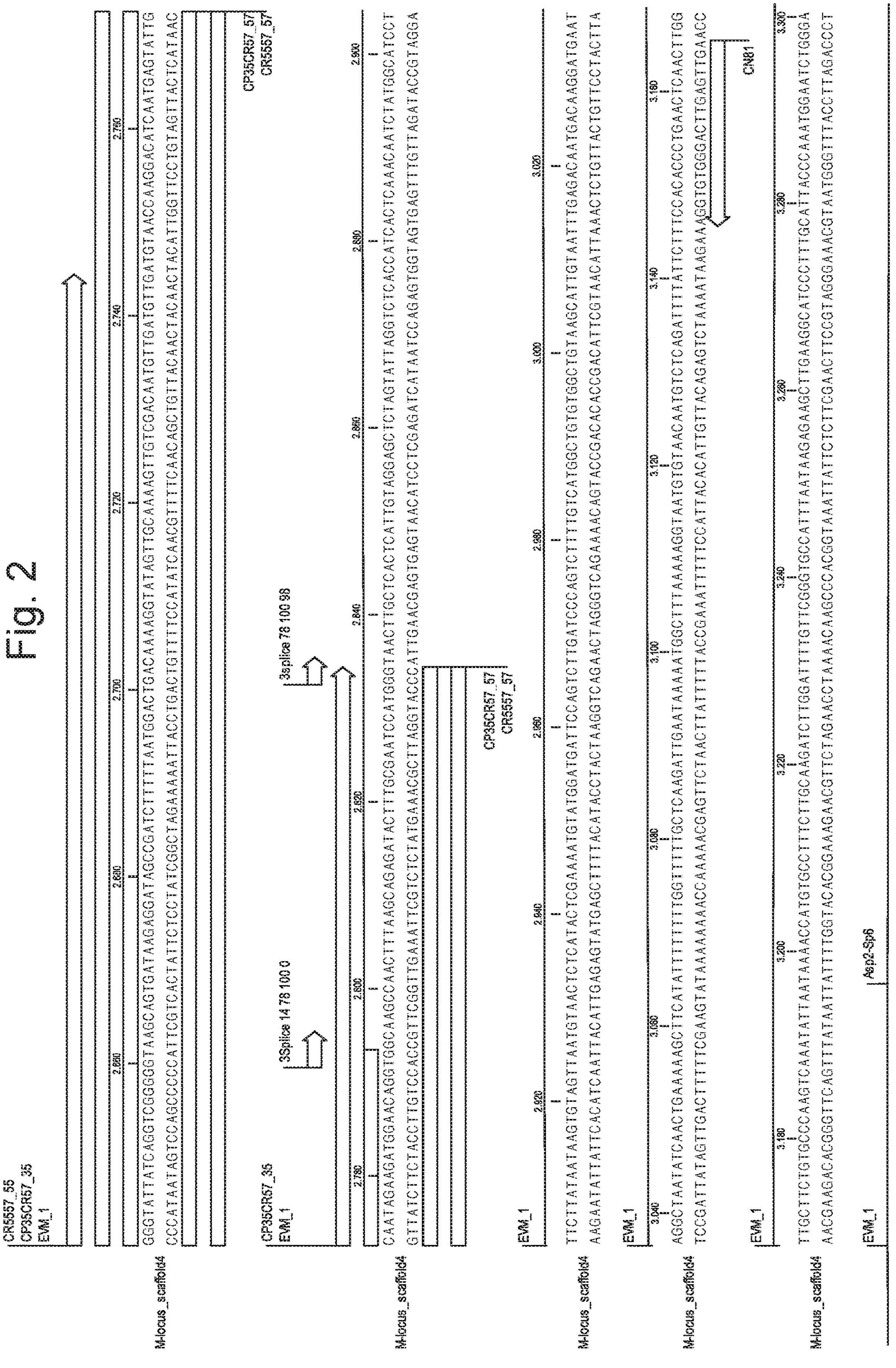

Both EVM annotations were translated and used as query in the alignment software BLASTP using a database of the non-redundant protein sequences (nr) of Genbank CDS translations plus protein sequences in the databases PDB, Swissprot, PIR and PRF (ncbi.nlm.org updated 2015 Jan. 5, 54183042 sequences). The sequences were limited to the Viridiplantae [ORGN] including a filter for low complexities. All other settings were default. The translation of evm_1.TU.M-locus_scaffold4.1 has no significant hits in the database. The translation of EVM_1 prediction M-locus_scaffold4.2 has a highly significant Identity (38.54%) to both the hypothetical protein VITISV_031339 of *Vitis vinifera* (Hit: CAN82114, Id: 147844299) and the predicted UPF0481 protein AT3G47200-like of *Vitis vinifera* (Hit: XP_010657662, Id: 731377489). Both entries were used in the conserved domain alignment at NCB' (http://www.ncbi.nlm.nih.gov/Structure/cdd/wrpsb.cgi) and have high similarity to members of the family Pfam03140, Plant protein of unknown function (Domain of Unknown Function, DUF247). The Pfam database is a large collection of protein families, each represented by multiple sequence alignments and hidden Markov models (HMMs). Current version is Pfam 27.0 (March 2013, 14831 families). The family Pfam03140 (PF3140) consists of 48 members and belongs to DUF247 Superfamily cl03911. The function of the plant proteins constituting this Superfamily is unknown. The DUF247-like gene sequence, which was temporarily called 'DUF247-like' was used as Query in a database of the Reference genome scaffolds AGS V1.10. Next to scaffold905 and pseudomolecule ML4 two DUF247-like sequences from two unrelated scaffolds were returned: region DUF247-like scaffold 3098 (1965 bp) and the region DUF247-like scaffold10515 (1422 bp). An alignment was created with Clustal Omega (Sievers et al., 2011) in standard settings. DUF247-like scaffold10515 aligns with 91% Identity from position 69 to 1186 in CDS2 and DUF-like scaffold3098 aligns with 92% Identity to position 1 to position 1970 in the second intron. The alignment is shown in FIG. 2. The DUF-like scaffold3098 gene is predicted in EVM1 and AUGUSTUS annotations (scaffold3098 scaffold3098:95411.97134 (+strand) class=gene length=1724) and supported by Cufflinks annotations (TCONS_00149163). The sequences of the above-discussed scaffolds can be found in FIG. 13.

In The *Arabidopsis* Information resource (TAIR10) the query term AT3G47200 was used and returned 2 loci matches, AT3G47200 and AT3G47210 with 5 distinct gene models. It was decided to investigate relationships of all *Arabidopsis* gene models found by BlastP in TAIR Protein (proteins) sequences using the translation of EVM_1 prediction M-locus_scaffold4.2 as query. The highest scores were AT3G50150.1, Plant protein of unknown function (DUF247), chr3:18595809-18597551 REVERSE LENGTH=509 (Score=201 bits (511), Expect=8e-52, Identities=133/425 (31%), Positives=216/425 (50%), Gaps=34/425 (8%)) and AT3G50160.1, Plant protein of unknown function (DUF247), chr3:18598826-18600903 REVERSE LENGTH=503 (197 bits (502), Expect=8e-51, Identities=132/413 (31%), Positives=207/413 (50%), Gaps=29/413 (7%)). Notably, the AT3G47200.1 gene model shows less identity: (DUF247), chr3:17377658-17379088 REVERSE LENGTH=476 (Score=130 bits (326), Expect=2e-30, Identities=104/417 (24%), Positives=195/417 (46%), Gaps=52/417 (12%)). The *Arabidopsis* genes with significant identities are listed in table X, column AGI Code. The translation of the paralogous sequences of DUF-like scaffold3098 also returns the highest scores for AT3G50150.1, Plant protein of unknown function (DUF247) aligning a less significant fraction of 181/454 amino acids. TAIR description of AT3G50150 and ATG3G50160 contains: Plant protein of unknown function (DUF247); INVOLVED IN: biological_process unknown LOCATED IN: plasma membrane: EXPRESSED IN: inflorescence meristem, petal; hypocotyl, root: EXPRESSED DURING 4 anthesis.

Figure 7A:
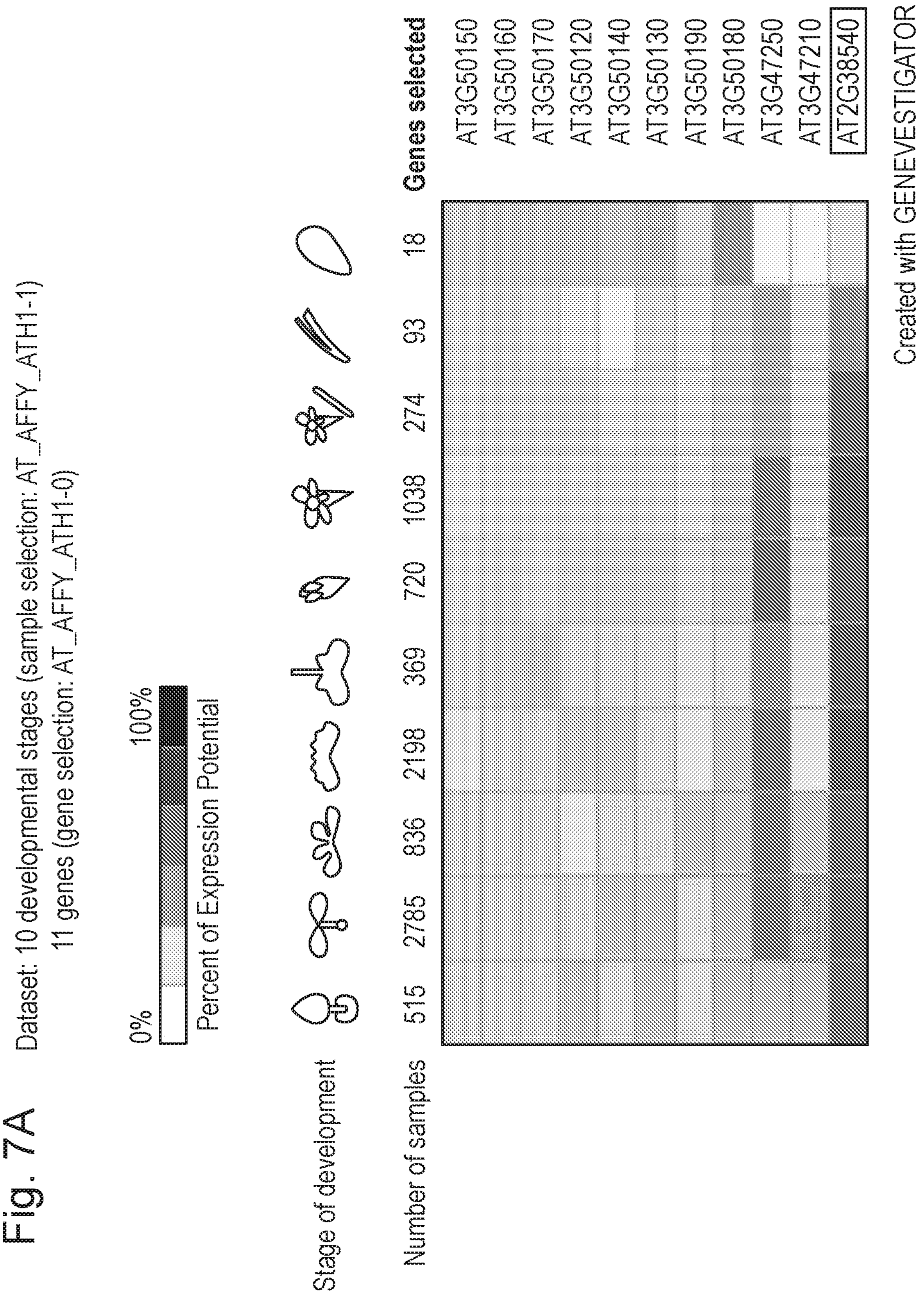
Figure 7B:
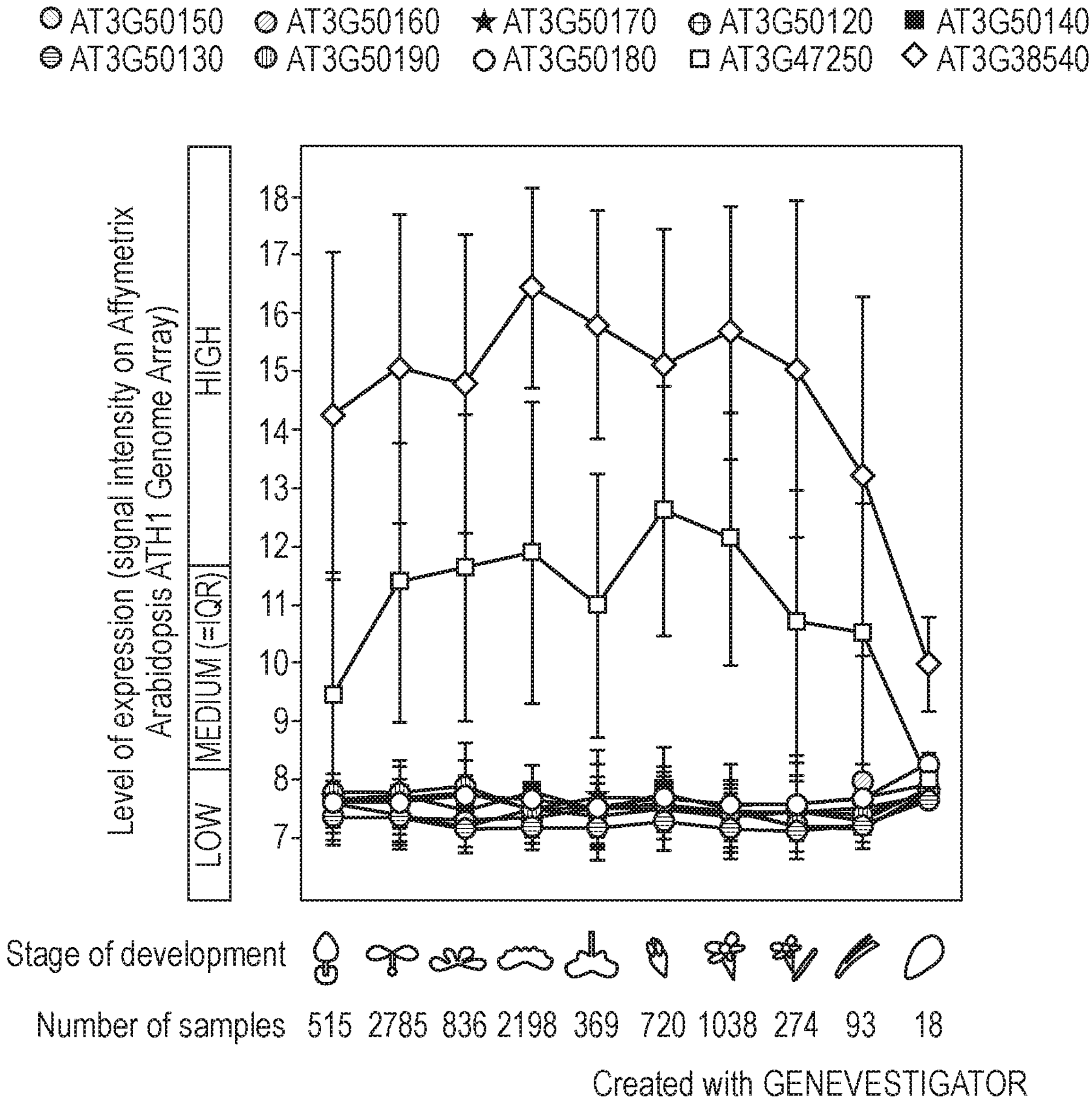
Figure 7C:
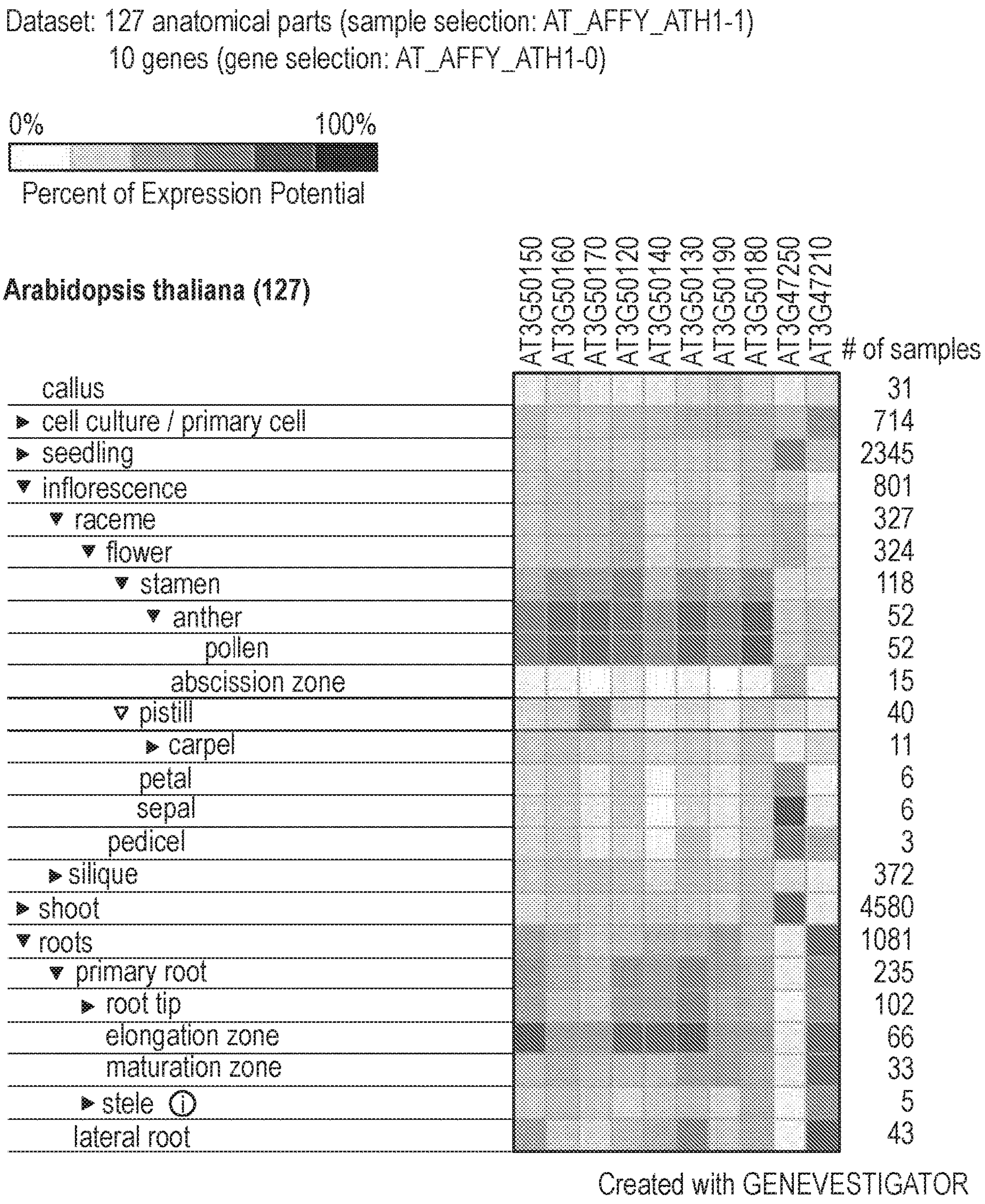
Figure 8A:
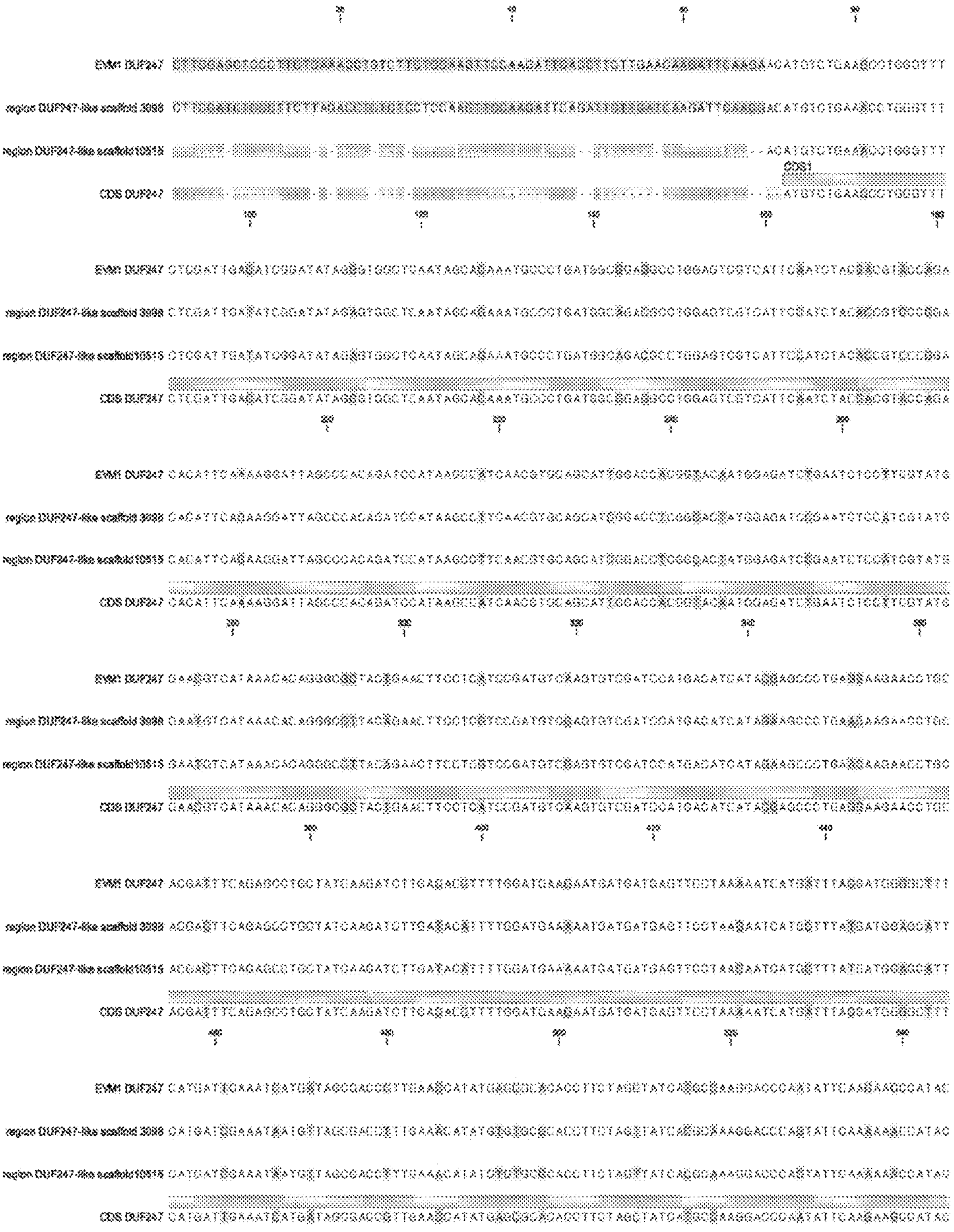
Figure 8B:
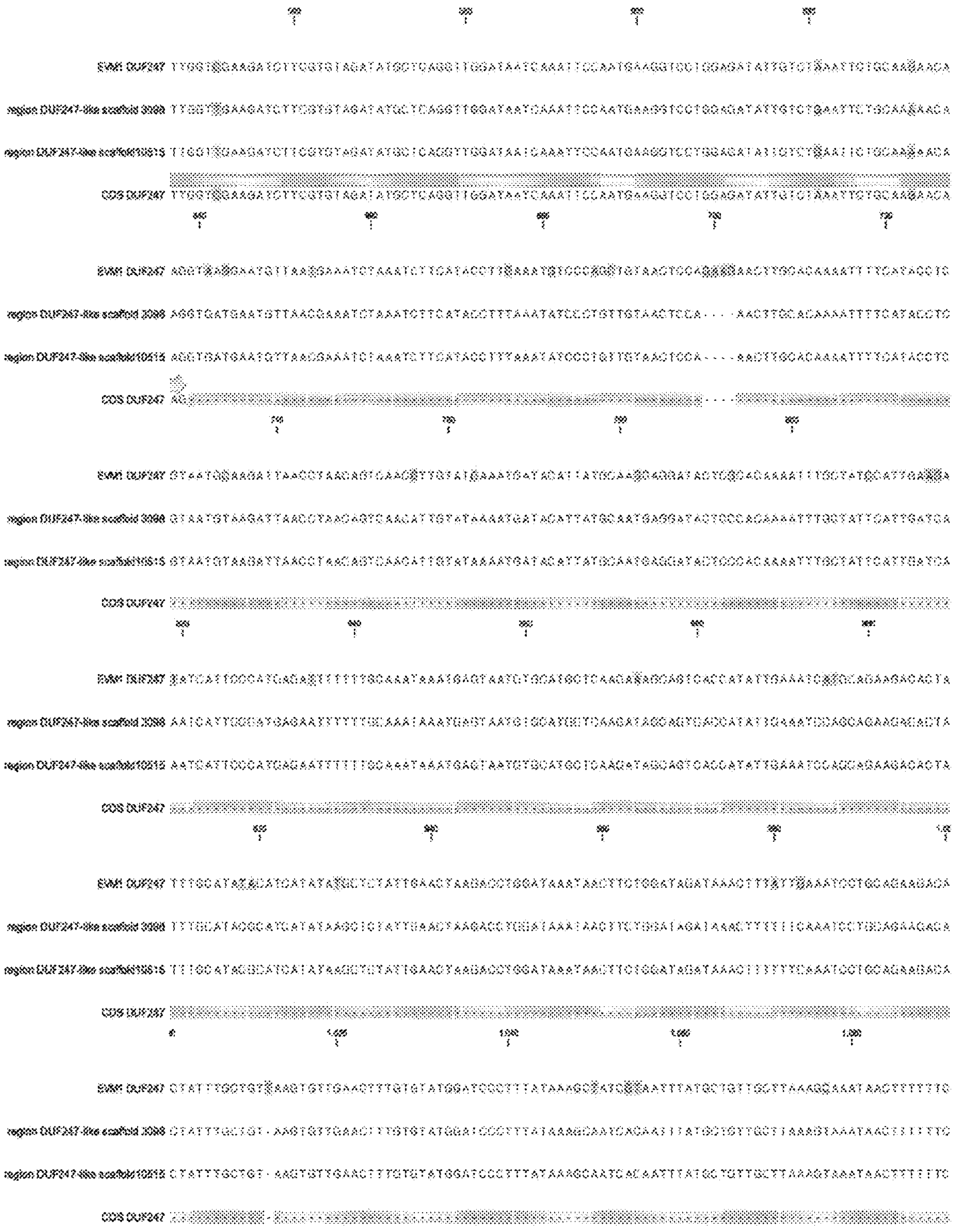
Figure 8C:
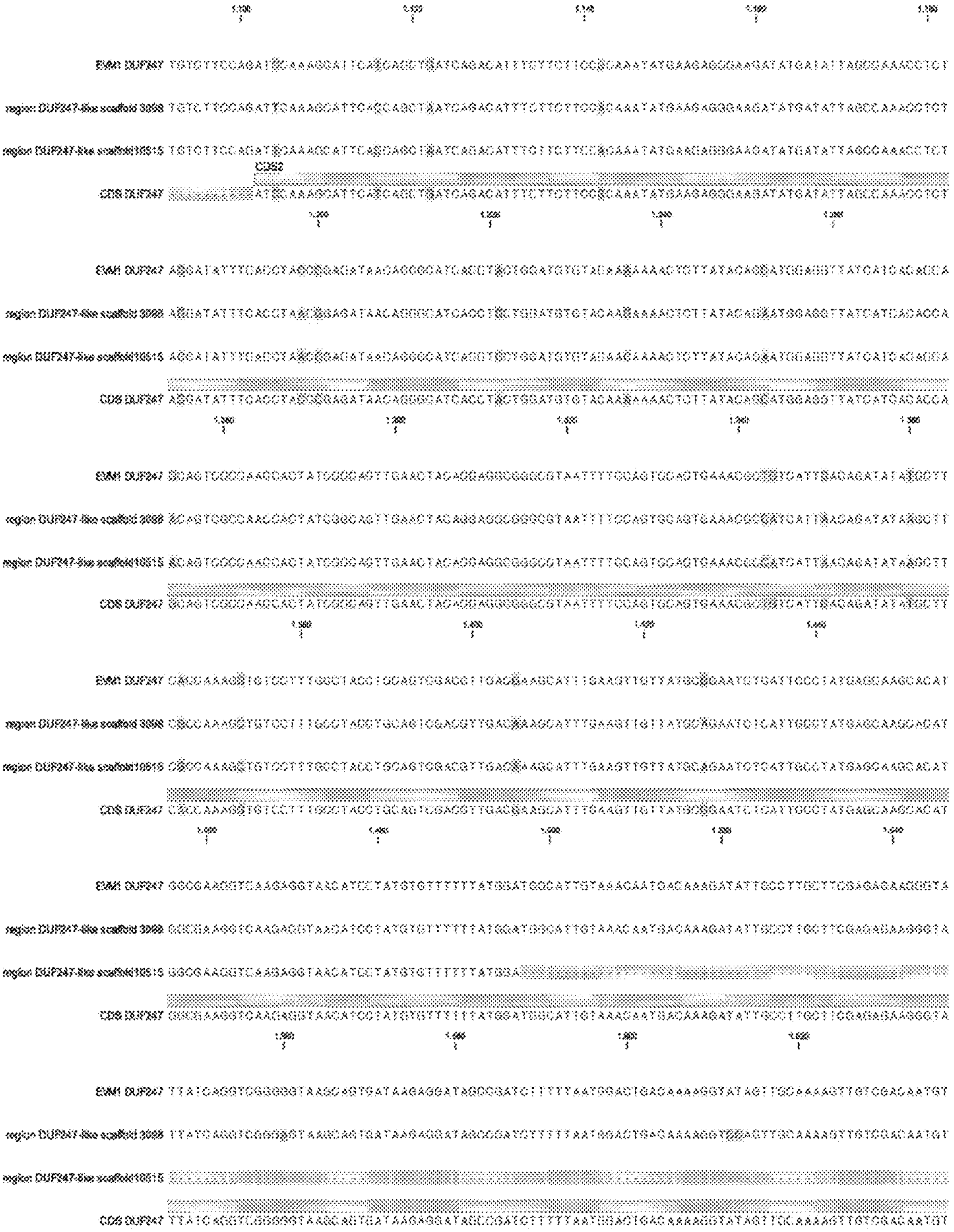
Figure 8D:
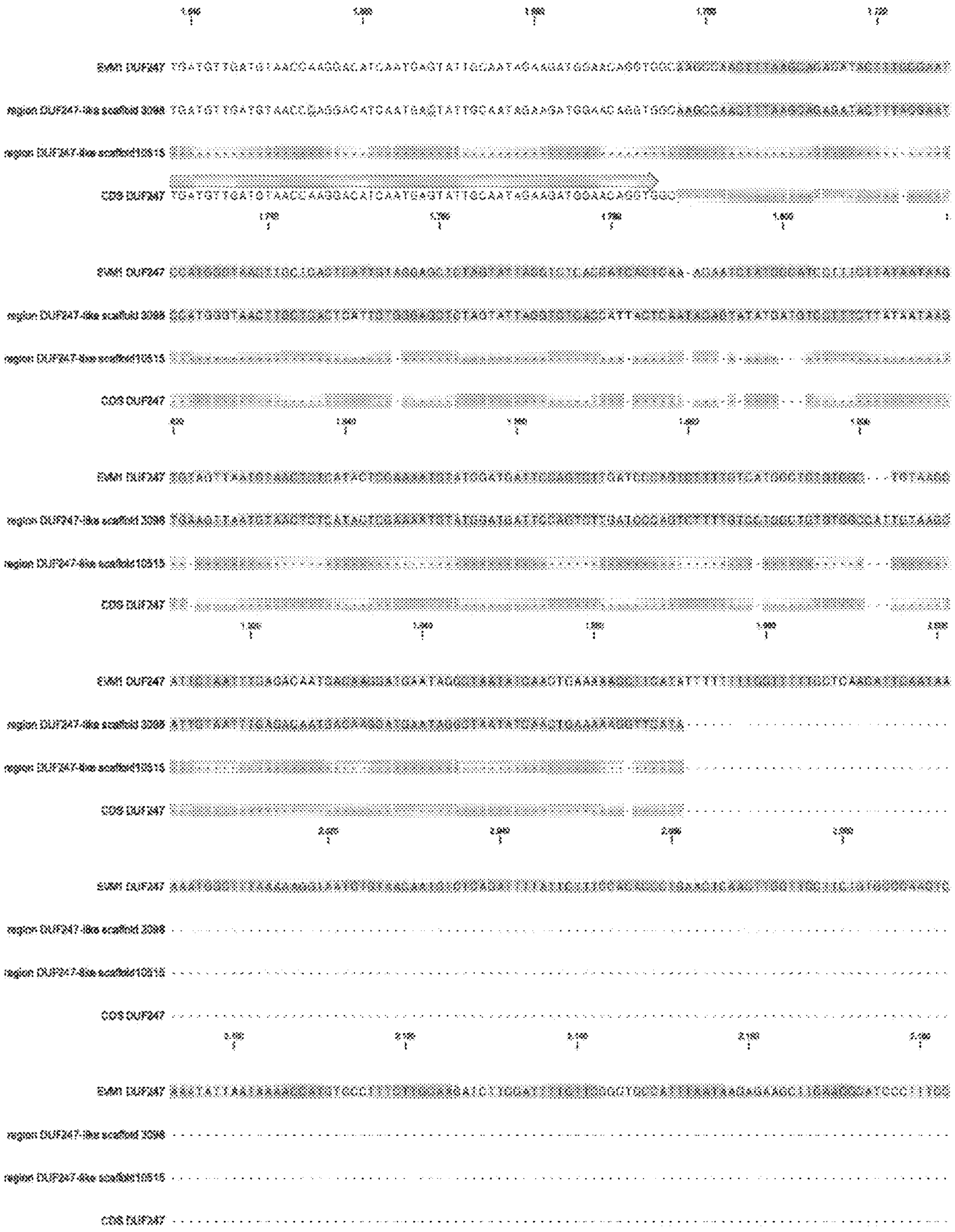
Figure 8E:
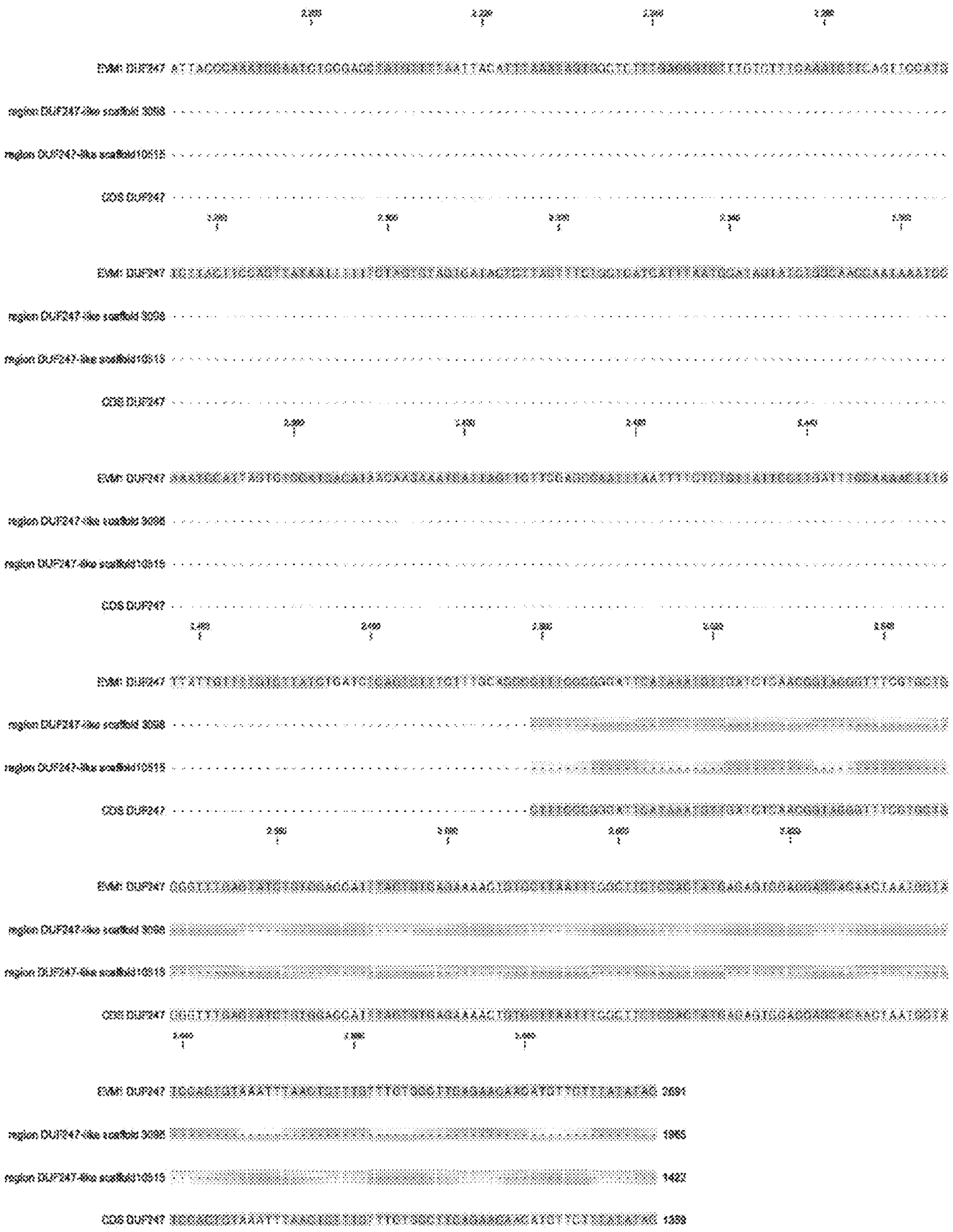
Figure 9C:
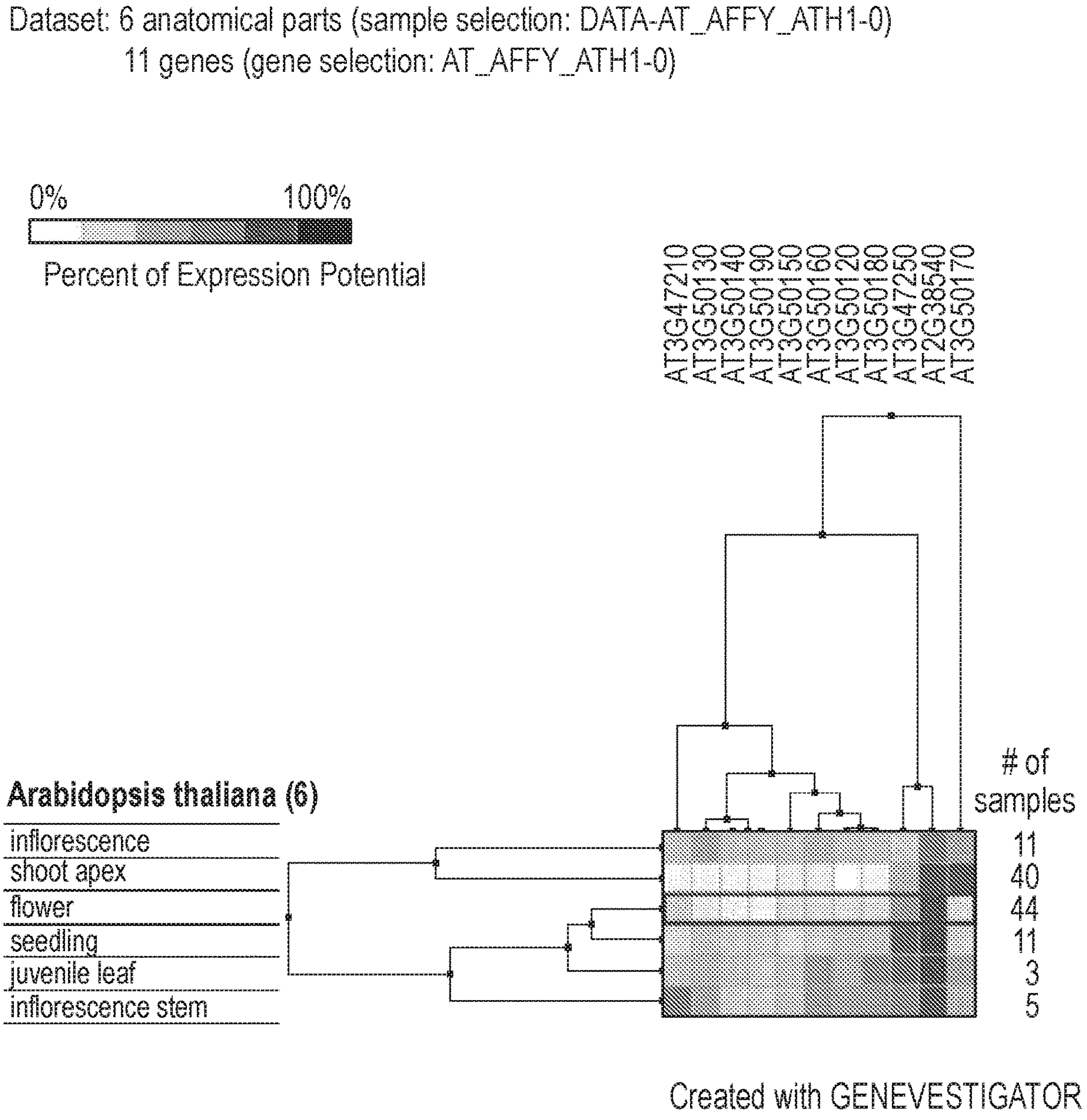

The external links were accessed for more information. The Plant Proteome database (PPDB) returns another four (4) gene models for *Arabidopsis* and 10 gene models in *Oryza sativa* datasets. The SubCellular Proteomic Database (SUBA3) houses large scale proteomic and GFP localization sets from cellular compartments of *Arabidopsis*. It also contains precompiled bioinformatics predictions for protein subcellular localizations. A new dataset of protein-protein interactions has recently been added. The predicted subcellular location for the AT3G47200 protein (nucleotide sequence derivable from GenBank accession no. AK221225.1) from both annotations as well as Ms/Ms experiments points to the plasma membrane, the peroxisome and plastid. None of the other databases has relevant information stored for this protein with one exception: the Phytozome Plant Gene Families databases (www.phytozome.net) displays cluster 38694300 having 922 members across 40 genome sequences of representatives of the Glade of Viridiplantae, including green algae. The ontologies associated with this family include PF03140 (DUF247) and Biological_process GO:0008150; when this term is used for annotation, it indicates that no information was available regarding the biological process of the gene product annotated. The evidence code ND, no data, is used to indicate this. A small number of ontologies include PF00043, the PfamA annotation of Glutathione S-transferase, C-terminal domain. Next to detoxification functions in eukaryotes, the domain is also found in proteins which harbor no such activities, such as the HSP26 family of stress-related proteins, which include auxin-regulated proteins in plants. To investigate expression profiles of family members of PF03140 in *Arabidopsis*, the GENEVESTIGATOR interface was explored (www.genevestigator.org, NEBION AG, Zurich, Switzerland). GENEVESTIGATOR is a high performance search engine for gene expression analysis. It integrates thousands of manually curated, well described public microarray and RNAseq experiments and visualizes gene expression across different biological contexts such as tissues or genotypes. In the Plant Biology database 10 species are described including 10,773 samples representing 600 studies of *Arabidopsis thaliana* microarray experiments. For these studies, the GeneChip® *Arabidopsis* ATH1 Genome Array (Affymetrix, Santa Clara, Calif.) experiments are curated. ATH1 is designed in collaboration with the former TIGR institute (now Craig Venter Institute, Rockville, Mass.) and contains more than 22 500 probe sets representing approximately 24,000 genes. In the CONDITIONS environment of GENEVESTIGATOR all ATH experiments were selected to investigate gene expression of the genes in table X, including At2G38540, the ATH TDF1 gene model for DEFECTIVE in TAPETAL DEVELOPMENT, as control (Jun Zhu, 2008). AT3G47200 is not found in the GENEVESTIGATOR ATIII data. An overview of the expression levels using all ATH experiments in 10 developmental stages of *Arabidopsis* displays a relatively low level of gene expression for all genes except for AT3G4725 and AT2G38540 which display higher gene expression in stages 2-9 as can be seen from the Percent of Expression Potential (FIG. 7A and FIG. 7B). An overview of all ATH experiments in 127 anatomical parts of *Arabidopsis* displays moderate gene expression for the listed PF3140 genes in all anatomical parts with the exception of the non-detected expression for AT3G47250 in roots and extremely low gene expression of all genes except for AT3G47250 in the abscission zone (FIG. 7C). The next experiment included the available four datasets for which gene expression in young and developed flower is described excluding samples with external perturbations in the experiments and curated for wild type *Arabidopsis* samples using the information in the cited literature and/or databases used. The selected anatomical parts now display very low Percent of Expression Potential in flowers for the listed PF3140 genes except for AT3G47210, AT3G47250 and the ATH TDF1 control (FIG. 9A). A detailed view of gene expression in early and late flowers displays no gene expression for five gene models taken into account that the number of experimental data was limited yet significant (FIG. 9A). The recalculated absolute expression levels in both stamen and pistil samples display the same result (data not shown). Hierarchical Clustering (Pearson correlation indices) of both anatomical parts and Percent of Expression Potential has high correlation values for the cluster {AT3G50130, AT3G50140, AT3G50190}, cluster {AT3G50150, AT3G50160, AT3G50120, AT3G50180} and unrelated cluster {AT3G250, AT2G38540} (FIG. 9C). In conclusion, careful mining of curated *Arabidopsis* gene expression data doe selected DUF247-like genes in GENEVESTIGATOR interfaces for correlation in gene expression in developmental stages and 127 anatomical parts displays three highly correlated clusters with virtually no gene expression in flowers compared to other organs for two clusters.

Moreover, the ATH TDF1 gene is expressed at high levels across all stages of development in a systemic way. One can speculate that DUF247—being a dominant Female suppressor gene, should indeed be virtually inactive in hermaphroditic *Arabidopsis* flowers whereas recessive Male promoting genes such as ATH TDF1 should be active in early and late flower development. It was decided to investigate whether or not mutations in the AT3G50150 gene and as such would give clear phenotypical differences compared to the non-mutated phenotype inferring a function of DUF247 in inflorescence development of *Asparagus officinalis*.

For this, the Nottingham *Arabidopsis* Stock Centre (N ASC, University of Nottingham, Loughborough, United Kingdom) was investigated for the availability of sequence-indexed mutant lines of the listed DUF247 gene models. For all gene models, germplasm of mutated lines could be made available by the NASC. It was investigated if the allele type i.e. a classification of alleles based upon the phenotype and genotype of alleles stated was known. The result being that none of the listed lines has been given reliable allele type and phenotype description in the TAIR and related databases such as NASC and AtGDB (http://www.plantgdb.org/AtGDB/). This was verified at the SALK Institute for the insertion lines indicated by the prefix SALK_ and indeed no allele type was available (J. Ecker, Salk Institute for Biological Studies, La Jolla Calif., USA). The six lines indicated 'investigated' were visually inspected on growth in general, flowering time, inflorescence architecture and spikelet formation. For this, typical experiments of −50 seeds of the lines, including the Col-0 genotype (Species Variant: 90) were briefly sterilized and plated on solid MS1 medium, placed for 24 hrs. in the dark at 4° C. and for germination under sterile conditions 10-15 days in growth chambers under continuous light, 23° C. The seedlings were transferred to soil and after 10 days their growth was monitored. For the genotypes indicated no clear phenotypes differentiating from the Col-0 background could be observed. For a subset of SALK_109348.55.50.X (AT3G50150), SALK_122060 (AT3G50160) and SALK_009839 (AT3G47200) flowers architecture was studied microscopically. The result being that in preparations of flower buds in stage 8-13, no relevant differences of flower anatomic parts compared to Col-0 background was observed (in collaboration with WUR, Dept. of Biochemistry, Wageningen, The Netherlands). It was concluded that upon visual inspection of six lines of DUF247-like *Arabidopsis* genes no clear phenotypical differences compared to Col-0 background could be observed thereby not inferring a biological function of DUF247 in inflorescence development of *Asparagus officinalis*. Further investigation of all homozygous mutant lines indicated will be performed using Digital Phenotyping in the KeyBox (KeyGene, Wageningen, The Netherlands).

TABLE X

*Arabidopsis thaliana* genes with significant identities to *Asparagus officinalis* DUF247-like gene. Indicated is the gene ID (AGI Code), predicted subcellular location (SUBA) and NASC ID and information of mutant lines for the genes. See text fordetails.

| AGI Code | SUB3A | NASC ID | TAIR Name | Gene Model(s) | Genotype | Allele mutagen | |
|---|---|---|---|---|---|---|---|
| AT3G50150 | mitochondrion | N673170 | SALK_109348.55.50.X | AT3G50150.1 | Homozygous | T-DNA insertion | investigated |
| AT3G50160 | mitochondrion | N622060 | SALK_122060 | AT3G50160.1 | segregating | T-DNA insertion | |
| AT3G50170 | peroxisome | N509186 | SALK_009186 | AT3G50170.1 | Homozygous | T-DNA insertion | investigated |
| AT3G50120 | Plasma membrane | N675592 | SALK_065145C | AT3G50120.1 | Homozygous | T-DNA insertion | investigated |
| AT3G50140 | plastid | N660145 | SALK_122700C | AT3G50140.1 | Homozygous | T-DNA insertion | |
| AT3G50130 | plastid | N470472 | GABI-KAT 735A08 | AT3G130.1 | segregating | T-DNA insertion | |
| AT3G50190 | plastid | N627332 | SALK_127332 | AT3G50190.1 | segregating | T-DNA insertion | |
| AT3G50180 | plastid | N677496 | SALK_151411C | AT2G50180.1 | Homozygous | T-DNA insertion | |
| AT3G47200 | plastid | N509839 | SALK_009839 | AT3G47200.1 | Homozygous | T-DNA insertion | investigated |
| AT3G47200 | | N509839 | SALK_009839 | AT3G47200.2 | Homozygous | T-DNA insertion | investigated |
| AT3G47250 | cytosol | N673179 | SALK_110471C | AT3G47250.3 | Homozygous | T-DNA insertion | |
| AT3G47250 | | N673179 | SALK_110471C | AT3G47250.2 | Homozygous | T-DNA insertion | |

TABLE X-continued

*Arabidopsis thaliana* genes with significant identities to *Asparagus officinalis* DUF247-like gene. Indicated is the gene ID (AGI Code), predicted subcellular location (SUBA) and NASC ID and information of mutant lines for the genes. See text fordetails.

| AGI Code | SUB3A | NASC ID | TAIR Name | Gene Model(s) | Genotype | Allele mutagen | |
|---|---|---|---|---|---|---|---|
| AT3G47250 | | N673179 | SALK_110471C | AT3G47250.1 | Homozygous | T-DNA insertion | |
| AT3G47210 | plastid | N657798 | SALK_121894.11.20X | AT3G47210.1 | Homozygous | T-DNA insertion | investigated |

As long as no clear phenotype has been observed in Arabidopsi this means that these DUF domain comprising *Arabidopsis* genes can be considered to be homologues to the GDS DUF247 gene of SEQ ID NO: 1.

It was decided that the ML4 DUF247-like gene was further investigated in several *Asparagus* genotypes. Dideoxy sequencing (Sanger sequencing) of was conducted in the region that includes the predicted DUF247-like gene using primer pairs designed using Primer 3 (Untergasser, 2007) These primers, referred to as CN59/CN60 CN67/CN68, CN69/CN70, CN71/CN72, CN59/CN70, CN67/CN82, CN69/CN81 are listed in Table 3. We have obtained sequences of four unrelated male plants DH00/086, 9M, 88M, K323, 12_25 and hermaphrodite Herma5375. The prediction in this example starts at the start codon predicted by the EVM model (see table 6). At nucleotide position 527 in CDS1, all male plants show a thymine base whereas the hermaphrodite shows a single base pair deletion at this position. This deletion will cause a frame-shift in the reading frame, a change of amino-acids and after splicing it likely causes a premature stop codon. The amino acids for the hermaphrodite as shown in white text against a black background and for CDS2 the anticipated premature stop codon is indicated. Besides the structural difference in the exon, unique to hermaphrodite 5375, two SNPs are found in the first intron in 9M and one SNP in CDS2 that is a synonymous substitution (a silent mutation that does not result into an amino-acids change). 12_25M, K323 and Herma 5375 show a single base pair INDEL in the predicted intron compared to the other sequenced males. In CDS3, no differences were found for the samples for which sequence data was available; DH00/086, K323, and Herma 5375. In addition, the results from the aforementioned second RNA-Seq experiment were included in the investigations of ML4 DUF247. The genotypes and their related samples selected for RNA-Seq analysis were the following: DH Male 1770=sample 1; DH Female 1800=sample 2; Herma 5375=sample 3; 5 plants AAff Herma of Pedigree 1E=Bulk 1 and 4 plants AaFf Males of pedigree 3E=Bulk 2. From each plant, three flower button stages were sampled: A) pre-meiosis (1.0-1.2 mm long for Herma and Male, 0.8-1.0 mm for Female); B) uni-nucleated microspores (1.6-1.8 mm), or just developed ovary (1.2-1.4 mm); C) fully developed carpels (just before sepal opening). The resulting RNA-Seq data was aligned to the Reference AGS V1.10 using TopHat 2.0.13 (Kim et al., 2014). The ML4 DUF247 EVM1 annotation was visually inspected. Firstly, gene expression is detectable but on average less than 2 Fragments Per Kilobase Of Exon Per Million Fragments Mapped (FPKM). A small number of aligned reads from the Male Bulk 2 and Male 1770 stage C show the same sequence in CDS1 as was obtained from RNA-Seq data from four unrelated Male plants DH00/086, 9M, 88M, K323, 12_25, including the Thymidine base at position 527 in CDS1. Two aligned reads from the Herma Bulk 1 showed the same single thymine deletion at position 527 in CSS1 as was obtained for the RNA-Seq data from Hernia 5373. In conclusion, in two separate RNA-Seq experiments executed with unrelated Male and Hermaphrodite *Asparagus* samples from flower organs, in all cases, a single base indel at position 527 of ML4 DUF247 CDS1 was detected causing a premature stop codon in the mRNA of ML4 DUF247.

To confirm the EVM annotation of the DUF247-like gene, expression was studied by isolating total RNA from flower buds of DH00/86 (the plant of the asparagus references sequence) and two other non-related plants. Total RNA was isolated using the RNeasy® Plant Mini Kit (Qiagen) according to the RNeasy Mini handbook (Qiagen) using 15 mg fresh young flower buds from asparagus and elder flowers which were completely opened, which were ground in liquid nitrogen. To avoid RNA degradation, RNase-free disposables and 0.1% DEPC treated pestles and glassware was used. Prior to cDNA synthesis, RNA was treated with DNase I (Sigma Aldrich) according to the manufacturer's protocol. Subsequently, cDNA was synthesized by using Maxima Reverse Transcriptase (Thermo Scientific) using 2 μl total RNA, 1 μl (200 U) Maxima Reverse Transcriptase, 100 pmol oligo(dT) primer, 0.5 mM dNTP mix (10 mM each), 5× RT buffer and RNase-free water in a final volume of 40 μl. The mixture was incubated for 30 minutes by 50° C., followed by inactivation at 85° C. for 5 minutes.

Following DNAse I-treatment according to the manufacturer's protocols (Thermo Scientific, Pittsburgh, Pa., Sigma-Aldrich, St. Louis, Mo.) the RNA quality was assessed on agarose electrophoresis and Agilent RNA Bioanalyzer protocols (Agilent, Santa Clara, Calif.). Subsequently, first strand cDNA was synthesized by using Maxima Reverse Transcriptase (Thermo Scientific Pittsburgh, Pa.) using 2 μl total RNA, 1 μl (200 U) Maxima Reverse Transcriptase and 100 pmol oligo(dT) primer. Specific PCR products were amplified using primers targeted at predicted exon positions (Table 3) using the prepared first-strand cDNA as template in a PCR using Phire Hot Start II DNA Polymerase (Thermo Scientific, Pittsburgh, Pa.). As control samples, genomic DNA was included as separate PCR templates. Primers pairs CR55/CR57, CP35/CR57, CP45/CR57, CP61/CP40, CP61/CR56, CP33/CP38, CP33/CP40 all yielded single PCR products which had sizes that corresponded well with gene predictions, as inferred from their migration on a 1,5% agarose gel compared to the GeneRuler 100 bp Plus DNA Ladder (Thermo Scientific, Pittsburgh, Pa.). Compared to the cDNA template the genomic control template always yielded longer fragments of expected sizes. Primer pairs CP61/CP62, CP33/CP62 failed to amplify any products on cDNA template, whereas genomic DNA template yielded fragments of expected sizes. For PCR products of CR55/CR57 and CP35/CR57 on first strand cDNA of the batch total RNA from flower buds in several developmental stages of DH00/086, both forward and reverse sequence reads were obtained by direct sequencing at BaseClear (Leiden, The Netherlands). The alignment of these 4 sequences showed that the 5'-splice site in AUGUSTUS and EVM1 annotations for the boundary of CDS2/Intron2 is not correct. In fact, the Cytosine at position 2795 in the generic sequence of ML4 has never been observed in *Arabidopsis* splice data (Szcześniak et al., 2013). The new splice site has the 100% preserved Guanine-Thymidine dinucleotide at positions 2834-2835 in the generic sequence of ML4. As a result a new stop codon is introduced (TGA) at positions 3616.3618 in the generic sequence and hence CDS3 is only 27 hp. The final spliced sequences for DUF247 EVM1 and for DUF247_DH as well as their respective translations are shown in FIG. 10. To address the 3'-Untranslated sequence of ML4 DUF247-like transcripts, a Rapid Amplification of cDNA Ends (3'-RACE) was designed. For this, the batch total RNA from flower buds in several developmental stages of DH00/086 was used. First strand cDNA was synthesized by using Maxima Reverse Transcriptase (Thermo Scientific Pittsburgh, Pa.) using 2 µl total RNA, 1 µl (200 U) Maxima Reverse Transcriptase and 100 pmol adaptor oligo(dT) primer (5'-GACCACGCGTATCGATGTCGACTFIT-TTTTTTTTTTTTTTTTVN) (SEQ ID NO: 16). The first strand cDNA was used for a linear PCR using forward primers CP39 and CP35. The products of these linear PCRs were diluted and used as template of a nested PCR, using CP41 (downstream CP39 and CP39 (downstream CP35) and a universe primer complementary to the tail of the adaptor oligo(dT) primer. After electrophoresis, The two PCR products were excised from an agarose and send for sequencing to Baseclear (Leiden, The Netherlands).

TABLE 3 primers used in Example 1.

| | | SEQ ID NOS |
|---|---|---|
| CN59 DUF 247 *M locus* scaffold 4 | *AAATTCTGCAAGAACAAGGTAAGG* | (17) |
| CN60 DUF 247 *M locus* scaffold 4 | *TACTGCAAAATTATGGTGAGCATT* | (18) |
| CN67 duf exon 1 fw | *CTTCGAGCTCCCTTCTCAAA* | (19) |
| CN68 duf exon 1 Rv | *TCAATCATGAAAGCCCCATC* | (20) |
| CN69 duf exon 2 fw | *TAAAGCTATCGTAATTTTATGCTGT* | (21) |
| CN70 duf exon 2 Rv | *TCAAATGCTTCGTCAACGTC* | (22) |
| CN71 duf exon 3 fw | *ATGGCGAAGGTCAAGAGGTA* | (23) |
| CN72 duf exon 3 Rv | *TGCCATAGATTGTTTGAGTGATG* | (24) |
| CN73 duf upstream Fw | *TAGATGAATCCCGGCCTTG* | (25) |
| CN74 duf upstream Rv | *TTGCAACAAGCCCATAAAAA* | (26) |
| CN78 DUF247 forward | *CATAAGCCATCAACGTGCAG* | (27) |
| CN81 duf exon 3 new reverse | *AGTTGAGTTCAGGGTGTGGA* | (28) |
| CN82 duf exon 1 new reverse | *AGGTTAATCTTGCATTACGAGGT* | (29) |
| CN83 gamma_1R points to the gene | *GCTCCGGCATTATCAAAGAG* | (30) |
| CN84 gamma_2R points to the gene | *CCGGCATTATCAAAGAGAGC* | (31) |
| CP31 DUF 247 scanning exon 1 pair 1 | *AGCCTGGGTTTCTCGATTGA* | (32) |
| CP32 DUF 247 scanning exon 1 pair 1 | *CCTCAGGGCTCGTATGATGT* | (33) |
| CP33 DUF 247 scanning exon 1 pair 2 | *TCCTCATCCGATGTCAAGTG* | (34) |
| CP34 DUF 247 scanning exon 1 pair 2 | *CGACCAAGTATGGCTTCTTGA* | (35) |
| CP35 DUF 247 scanning exon 1 pair 3 | ATCATGCCAAGGACCCAATA | (36) |
| CP38 DUF 247 scanning exon 2 pair 1 | ATGACAGCGTTTCACTGCAC | (37) |
| CP39 DUF 247 scanning exon 2 pair 2 | CTGTCATTGACAGATATATGCTTCA | (38) |
| CP40 DUF 247 scanning exon 2 pair 2 | TGCAACTATACCTTTTGTCAGTCC | (39) |
| CP41 DUF 247 scanning exon 2 & CN72 | GTCGGGGGTAAGCAGTGATA | (40) |
| CP45 DUF 247 primer | AGAAAACAGTGGAATTGCG | (41) |
| CP61 DUF247 cDNA primer Fw 1 | ATGGCGGAGGCCTGGA | (42) |
| CP62 DUF247 cDNA primer Rv | TTAACTACACTTATTATAAGAAAGGATG | (43) |
| CR37 dCAPS primer Hpy188III T deletion 5375 | GGGCGGGCAGGTTGGATAATCAAATTTCAA | (44) |

TABLE 3-continued primers used in Example 1.

| | | SEQ ID NOS |
|---|---|---|
| CR38 dCAPS primer Hpy188III T deletion 5375 | ACAGCTGGGACATTTCAAGG | (45) |
| CR39 DUF T deletion HRM marker | CTCAGGTTGGATAATCAAATTCCA | (46) |
| CR40 DUF T deletion HRM marker | AGACAATATCTCCAGGACCTT | (47) |
| CR55 EVM prediction check DUF247 Fw | ATGTCTGAAGCCTGGGTTTC | (48) |
| CR56 FGENESH check DUF247 exon 2 Rv | TTACCCATGGATTCGCAAAG | (49) |
| CR57 EVM exon 3 check 247 Rv | TGTTCTCAAGCCACAAACAA | (50) |
| CK63 Asp_80-HRM | TCTGGCACTAAGAATCAGTTCCT | (51) |
| CK64 Asp_80-HRM | GCGAGTTTCCAACGAAATTA | (52) |
| CP80 DUF247 exon SNP-HRM | TTATACAGCATGGAGGTTATCATCACA | (53) |
| CP81 DUF247 exon SNP-HRM | CGATAGTGGTTGGCGAC | (54) |
| CM45 comp49320_c1F2 :Zf- AN1 HRM | GCAGTTGTTGATGCAGAGGA | (55) |
| CM46 comp49320_c1R2 :Zf- AN1 HRM | GAAACAATGGAGCACCACAA | (56) |
| CS77 bisulfite primer pair 2F | TGGATGAAGAATGATGATGAGTTT | (57) |
| CS78 bisulfite primer pair 2R | TTTCATTAACATTCCTTACCTTATTCT | (58) |
| CN96 905 scaffold start HRM | GTGAGCTTAGGGCTTATGTT | (59) |
| CN97 905 scaffold start HRM | CATCTTCTCATAATGACCCAAATATTT | (60) |
| CQ31 scaffold 2312 | ATGGATTCGACTCGGAGACT | (61) |
| CQ32 scaffold 2312 | TGAGTTGAGAGGGTGGAGGA | (62) |
| CT13 scaffold 206 Asp448 like for K1036 new | AGGAAATTTTGCACTCAAAGGTA | (63) |
| CT14 scaffold 206 Asp448 like for K1036 new | GCTTCTGTTGCAGTGCA | (64) |
| CE40 Asp448 fw BseNI CAPS marker | GTTGCAGTGCAGAAGACCAA | (65) |
| CE41 Asp448 Rv BseNI CAPS marker | GAACAGGGGCATTTGACAGT | (66) |
| CE64 contig04556 | CTCAAGGGGCTTGTTTGTTC | (67) |
| CE65 contig04556 | CGTTTATGGGTTGGACCACT | (68) |
| CR61 DUF 247 scanning exon 3 pair 1 | TGTGCTTAATTTCGCTTCTCCACT | (69) |
| CT72 Scaffold 1204 HRM for Peru deletion mut | GCTGGAATTGATTACTTCGCC | (70) |
| CT73 Scaffold 1204 HRM for Peru deletion mut | GATGAGAGTCGCGAGACAC | (71) |
| CE64 M-locus HRM | CTCAAGGGGCTTGTTTGTTC | (72) |
| CE66 M-locus HRM | GCCACGGCCTAGTTTAAGAA | (73) |
| CT33 DEFECTIVE IN MERISTEM DEVELOPMENT AND FUNCTION F3 | TCATCCAATGTGGTGCTTGT | (74) |
| CT34 DEFECTIVE IN MERISTEM DEVELOPMENT AND FUNCTION R2 | CCATATCCATTCACCACCAA | (75) |
| CT33 DEFECTIVE IN MERISTEM DEVELOPMENT AND FUNCTION F3 | ACCCTCCACCCTTCAACAC | (76) |
| CT34 DEFECTIVE IN MERISTEM DEVELOPMENT AND FUNCTION R3 | CCATATCCATTCACCACCAA | (77) |
| CL44 scaffold 1194-HRM | GTCCTGCAGATAAATTAAGTGCGT | (78) |
| CL45 scaffold 1194-HRM | TCAGGTCTACTAATACTCAAACAGCT | (79) |

TABLE 3-continued primers used in Example 1.

| | | SEQ ID NOS |
|---|---|---|
| CM98 Asp_446_HRM scaffold 1539 | GGTAGTTTTGTAGGGCCCA | (80) |
| CM99 Asp_446_HRM scaffold 1539 | AAAAGGCACCAAATTTAAGGC | (81) |
| CL83 ARM HRM Marker on scaffold 945 | GATGTCCACCAAACTTTCTAGCT | (82) |
| CL84 ARM HRM Marker on scaffold 945 | TGGCTGAATAAAACTTGTGTCAA | (83) |
| CK33 Asp_432-HRM | GCCTCGAAAGCTCTTCTTCT | (84) |
| CK34 Asp_432-HRM | TGCATAAGCAGTAACTCCAAACA | (85) |
| CN94 Tapetum related gene scaffold 905 | ATTAAGCCTAACTATCAAAATAGTCCAA | (86) |
| CN95 Tapetum related gene scaffold 905 | ACCTATCAGCTGAGAAATTCAATG | (87) |

These results demonstrate that the DUF247 like-gene is expressed in flower buds and that the expressed gene sequence of the hermaphrodite (at least) differs by a single nucleotide deletion from the gene sequence of male plants. It was already mentioned that the gene was found in close proximity to published sex linked markers. In order to demonstrate linkage of the mutation itself and the hermaphrodite flower trait we have analyzed several plants of pedigree Cross 3E. We have used primer pair CR39/CR40 (Table 3) in a High Resolution Melting Curve analysis, which essentially follows the method described in Wittwer et al (2003). Results are shown in Table 1e. The results show full co-segregation of the marker and the hermaphrodite trait. All twelve hermaphrodites have the marker allele diagnostic for the thymine deletion whereas all twelve male plants had the wild type gene allele. This confirmed that the single hermaphrodite plant, that was previously described to have an unexpected 166/166 AO022 microsatellite marker genotype indeed resulted from a recombination event between the 166 allele and the gynoecium development repressor gene as also this plant shows the CR39/CR40 marker genotype diagnostic for the single base pair deletion and must have the 'Aaff' genotype. This results was confirmed using a dCAPS marker using primers pairs CR37/CR38 and the restriction enzyme Hpy188III. These markers thus are suitable for detection of this specific deletion mutant and can as such be used in diagnostic and breeding methods described in this application. Based on the evidenced provided above it was concluded that the DUF247-like gene is the Gynoecium Development Supressor (GDS) gene, In general, it can be said that many of the markers that are mentioned in the present application may be suitable to indicate the presence of a mutation in the GDS gene or near the GDS gene and/or are suitable to indicate the presence of the allele of the GDS gene. Preferably such markers target the GDS gene, its mutants or alleles or 5'UTR or 3'UTR or its cis regulatory elements. However, other markers can also be used to suitably indicate the presence of a mutation in the GDS gene or near the GDS gene and/or are suitable to indicate the presence of the allele of the GDS gene, when these markers, genetically linked to the GDS gene can disclose polymorphism(s) in a plant that has been shown to have a mutation in or near the GDS gene that will cause reduced functional expression of the GDS gene. All such markers thus could advantageously be used in marker assisted breeding. Primer pairs that can be used for detection of a mutation may be selected from the group of CN67/CN68, CN69/CN70, CN71/CN72, CN59/CN70, CN67/CN82, CN69/CN81, CP31/CP32, CP33/CP34, CP35/CP36, CP37/CP38, CP39/C40, CP41/CN72, CR61/CR57, CP35/CR57, but other combinations of these primers and/or with other primers mentioned in Table 3 will be possible.

Further, markers that are located near to the GDS gene locus and which may be used in marker assisted breeding are, next to the ones that already have been mentioned above, such as AO022 and Asp 1-T7, listed in Table 5.

TABLE 5

Markers that can be advantageously used in marker assisted breeding for the GDS gene.

| | | | SEQ ID NOS: |
|---|---|---|---|
| CK63 | Asp_80-HRM | TCTGGCACTAAGAATCAGTTCCT | (88) |
| CK64 | Asp_80-HRM | GCGAGTTTCCAACGAAATTA | (89) |
| CK33 | Asp_432-HRM | GCCTCGAAAGCTCTTCTTCT | (90) |
| CK34 | Asp_432-HRM | TGCATAAGCAGTAACTCCAAACA | (91) |
| CE40 | Asp448-BseNI | GTTGCAGTGCAGAAGACCAA | (92) |
| CE41 | Asp448-BseNI | GAACAGGGGCATTTGACAGT | (93) |

It has thus been shown that an exceptional hermaphrodite plant has been obtained following tissue culture, which is more capable of producing berries than any of its known male ancestors, that has a single nucleotide deletion in a gene, now designated a Gynoecium Development Suppressor gene, located on a hemizygous region that was targeted by published genetic markers. Further, it has been shown that a GDS gene having this single nucleotide deletion co-segregates with the plants thereby maintaining the hermaphrodite phenotype. The tissue culture methods that has been applied essentially follows the method published by Qiao & Falavigna (1990) Briefly; an anther is grafted in an embryo induction medium that contains 2,4D, an embryo-like structure (a ball of 1 mm diameter) is obtained that is transferred to a next medium designed to generate callus from which shoot sprout, these shoots are chopped into pieces to allow new shoot formation from axillary meristems, finally shoots are placed on a rooting induction medium to obtain rooted mini-crows that can finally transferred to the greenhouse. Since the 1980's of the previous century it has been recognized that tissue culture of plants poses the risk of somaclonal variation (Evans et al 1984). Somaclonal variation may include point mutations (Jiang et al 2011) Somaclonal variation has been recognized as possibility recover of novel genotypes. (Evans & Bravo, 1986) Somaclonal variation has been described to result in phenotypic variants of asparagus including plants showing differences in flower morphology. Pontaroli & Camadro (2005) compared plant height, cladode length and shape, foliage color, of the respective donor clones and their regenerants. These authors obtained regenerants of which one was which was greenish blue (glaucous) rather than green as the donor and all the other regenerants. More importantly to our example, Pontaroli & Camadro (2005) obtained regenerants with aberrant flowers with a higher than normal number of stamens of which some were adhered to the tepals, some tepals also being fused with the terminal cladodes.

The particular mutation observed in 5375 likely resulted from somaclonal variation that could potentially occur in the anther culture following the method of Qiao & Falavigna (1990) because the plants from which tissue was taken to start the culture have not shown a hermaphrodite phenotype.

As will be pointed out in EXAMPLE 6 and EXAMPLE 2 the GDS gene is located in a chromosome region hemizygous in males that is absent in females. The result of this is that a single loss of function allele of the GDS gene, if it occurs in vivo in a heterozygous male, will not be masked by another wild type allele of the GDS gene and has a low probability to be left unnoticed.

TABLE 6

Coding sequences (CDS) of predicted exons DUF247 FG (FGenesh prediction) and DUF247 EVM (Evidence Modeler prediction) and detected cDNA sequences (DUF247 DH). Below are their respective conceptual translations of the CDS structures

| | |
|---|---|
| ML4<br>DUF247<br>EVM CDS1<br>768 . . . 1334<br>SEQ ID NO: 94 | ATGTCTGAAGCCTGGGTTTCTCGATTGACATCGGATATAGGGTGGCTCAATAGC<br>ACAAATGCCCTGATGGCGGAGGCCTGGAGTCGTCATTCAATCTACGACGTACCA<br>GACACATTCAAAAGGATTAGCCCACAGATCCATAAGCCATCAACGTGCAGCATT<br>GGACCACGGTACAATGGAGATCTGAATCTCCTTCGTATGGAACGTCATAAACAC<br>AGGGCGCTACTGAACTTCCTCATCCGATGTCAAGTGTCGATCCATGACATCATA<br>CGAGCCCTGAGGAAGAACCTGCACGATTTCAGAGCCTGCTATCAAGATCTTGAC<br>ACCTTTTGGATGAAGAATGATGATGAGTTCCTAAAAATCATGATTTACGATGGG<br>GCTTTCATGATTGAAATCATGATAGCGACCGTTGAACCATATGAGCGCACACCT<br>TCTAGCTATCATGCCAAGGACCCAATATTCAAGAAGCCATACTTGGTCGAAGAT<br>CTTCGTGTAGATATGCTCAGGTTGGATAATCAAATTCCAATGAAGGTCCTGGAG<br>ATATTGTCTAAATTCTGCAAGAACAAG |
| ML4<br>DUF247<br>EVM CDS2<br>1798 . . . 2390<br>SEQ ID NO: 96 | ATCCAAAGCATTCATCAGCTGATCAGACATTTCTTCTTCCGCAAATATGAAGAG<br>GGAAGATATGATATTAGCCAAACCTCTACGATATTTCACCTACCCGAGATAACA<br>GGGCATCACCTACTGGATGTGTACAAAAAAACTCTTATACAGCATGGAGGTTAT<br>CATCACACCAGCAGTCGCCAACCACTATCGGCAGTTGAACTACAGGAGGCGGGC<br>GTAATTTTCCAGTGCAGTGAAACGCTGTCATTGACAGATATATGCTTCACCAAA<br>GGTGTCCTTTGCCTACCTGCAGTCGACGTTGACGAAGCATTTGAAGTTGTTATG<br>CGGAATCTCATTGCCTATGAGCAAGCACATGGCGAAGGTCAAGAGGTAACATCC<br>TATGTGTTTTTTATGGATGGCATTGTAAACAATGACAAAGATATTGCCTTGCTT<br>CGAGAGAAGGGTATTATCAGGTCGGGGGTAAGCAGTGATAAGAGGATAGCCGAT<br>CTTTTTAATGGACTGACAAAAGGTATAGTTGCAAAAGTTGTCGACAATGTTGAT<br>GTTGATGTAACCAAGGACATCAATGAGTATTGCAATAGAAGATGGAACAGGTG |
| ML4<br>DUF247<br>EVM CDS3<br>3189 . . . 3387<br>SEQ ID NO: 98 | GCCTTTCCCGGGATTCATAAATGTTGATCTCAACGGTAGGGTTTCGTGCTGGGG<br>TTTGAGTATCTGTGGAGCATTTAGTGTGAGAAAACTGTGCTTAATTTCGCTTCT<br>CCACTATGAGAGTGGAGGAGCACAACTAATGGTATCCAGTGTAAATTTAACTCT<br>TTGTTTGTGGCTTGAGAACAACATGTTCTTTATATAG |
| ML4<br>DUF247<br>DH CDS1<br>768 . . . 1334<br>SEQ ID NO: 100 | ATGTCTGAAGCCTGGGTTTCTCGATTGACATCGGATATAGGGTGGCTCAATAGC<br>ACAAATGCCCTGATGGCGGAGGCCTGGAGTCGTCATTCAATCTACGACGTACCA<br>GACACATTCAAAAGGATTAGCCCACAGATCCATAAGCCATCAACGTGCAGCATT<br>GGACCACGGTACAATGGAGATCTGAATCTCCTTCGTATGGAACGTCATAAACAC<br>AGGGCGCTACTGAACTTCCTCATCCGATGTCAAGTGTCGATCCATGACATCATA<br>CGAGCCCTGAGGAAGAACCTGCACGATTTCAGAGCCTGCTATCAAGATCTTGAC<br>ACCTTTTGGATGAAGAATGATGATGAGTTCCTAAAAATCATGATTTACGATGGG<br>GCTTTCATGATTGAAATCATGATAGCGACCGTTGAACCATATGAGCGCACACCT<br>TCTAGCTATCATGCCAAGGACCCAATATTCAAGAAGCCATACTTGGTCGAAGAT<br>CTTCGTGTAGATATGCTCAGGTTGGATAATCAAATTCCAATGAAGGTCCTGGAG<br>ATATTGTCTAAATTCTGCAAGAACAAG |
| ML4<br>DUF247<br>DH CDS2<br>1798 . . . 2430<br>SEQ ID NO: 102 | ATCCAAAGCATTCATCAGCTGATCAGACATTTCTTCTTCCGCAAATATGAAGAG<br>GGAAGATATGATATTAGCCAAACCTCTACGATATTTCACCTACCCGAGATAACA<br>GGGCATCACCTACTGGATGTGTACAAAAAAACTCTTATACAGCATGGAGGTTAT<br>CATCACACCAGCAGTCGCCAACCACTATCGGCAGTTGAACTACAGGAGGCGGGC<br>GTAATTTTCCAGTGCAGTGAAACGCTGTCATTGACAGATATATGCTTCACCAAA<br>GGTGTCCTTTGCCTACCTGCAGTCGACGTTGACGAAGCATTTGAAGTTGTTATG<br>CGGAATCTCATTGCCTATGAGCAAGCACATGGCGAAGGTCAAGAGGTAACATCC |

TABLE 6-continued

| Coding sequences (CDS) of predicted exons DUF247 FG (FGenesh prediction) and DUF247 EVM (Evidence Modeler prediction) and detected cDNA sequences (DUF247 DH). Below are their respective conceptual translations of the CDS structures | |
|---|---|
| | TATGTGTTTTTTATGGATGGCATTGTAAACAATGACAAAGATATTGCCTTGCTT<br>CGAGAGAAGGGTATTATCAGGTCGGGGGTAAGCAGTGATAAGAGGATAGCCGAT<br>CTTTTTAATGGACTGACAAAAGGTATAGTTGCAAAAGTTGTCGACAATGTTGAT<br>GTTGATGTAACCAAGGACATCAATGAGTATTGCAATAGAAGATGGAACAGGTGG<br>CAAGCCAACTTTAAGCAGAGATACTTTGCGAATCCATGG |
| ML4<br>DUF247<br>DH CDS3<br>3189 . . . 3215<br>SEQ ID NO: 104 | GCCTTTCCCGGGATTCATAAATGTTGA |
| ML4<br>DUF247<br>FG CDSf<br>834 . . . 1334<br>SEQ ID NO: 106 | ATGGCGGAGGCCTGGAGTCGTCATTCAATCTACGACGTACCAGACACATTCAAA<br>AGGATTAGCCCACAGATCCATAAGCCATCAACGTGCAGCATTGGACCACGGTAC<br>AATGGAGATCTGAATCTCCTTCGTATGGAACGTCATAAACACAGGGCGCTACTG<br>AACTTCCTCATCCGATGTCAAGTGTCGATCCATGACATCATACGAGCCCTGAGG<br>AAGAACCTGCACGATTTCAGAGCCTGCTATCAAGATCTTGACACCTTTTGGATG<br>AAGAATGATGATGAGTTCCTAAAAATCATGATTTACGATGGGGCTTTCATGATT<br>GAAATCATGATAGCGACCGTTGAACCATATGAGCGCACACCTTCTAGCTATCAT<br>GCCAAGGACCCAATATTCAAGAAGCCATACTTGGTCGAAGATCTTCGTGTAGAT<br>ATGCTCAGGTTGGATAATCAAATTCCAATGAAGGTCCTGGAGATATTGTCTAAA<br>TTCTGCAAGAACAAG |
| ML4<br>DUF247<br>FG CDS1<br>SEQ ID NO: 108 | ATCCAAAGCATTCATCAGCTGATCAGACATTTCTTCTTCCGCAAATATGAAGAG<br>GGAAGATATGATATTAGCCAAACCTCTACGATATTTCACCTACCCGAGATAACA<br>GGGCATCACCTACTGGATGTGTACAAAAAAACTCTTATACAGCATGGAGGTTAT<br>CATCACACCAGCAGTCGCCAACCACTATCGGCAGTTGAACTACAGGAGGCGGGC<br>GTAATTTTCCAGTGCAGTGAAACGCTGTCATTGACAGATATATGCTTCACCAAA<br>GGTGTCCTTTGCCTACCTGCAGTCGACGTTGACGAAGCATTTGAAGTTGTTATG<br>CGGAATCTCATTGCCTATGAGCAAGCACATGGCGAAGGTCAAGAGGTAACATCC<br>TATGTGTTTTTTATGGATGGCATTGTAAACAATGACAAAGATATTGCCTTGCTT<br>CGAGAGAAGGGTATTATCAGGTCGGGGGTAAGCAGTGATAAGAGGATAGCCGAT<br>CTTTTTAATGGACTGACAAAAGGTATAGTTGCAAAAGTTGTCGACAATGTTGAT<br>GTTGATGTAACCAAGGACATCAATGAGTATTGCAATAGAAGATGGAACAGGTGG<br>CAAGCCAACTTTAAGCAGAGATACTTTGCGAATCCATGGGTAACTTGCTCACTC<br>ATTGTAGGAGCTCTAGTATTAGGTCTCACCATCACTCAAACAATCTATGGCATC<br>CTTT |

Example 2

Genetic Analysis of Hermaphrodite Mutant K323-G33

All male hybrid K323 is a cross between female doubled haploid LIM425 obtained from an anther culture of the cultivar Gladio and a male doubled haploid L1M428 obtained from an anther culture of the cultivar Gijnlim.

LIM428 was selected as parental plant because it, among other criteria, was not capable of producing berries. Although male hybrid K323 has a rudimentary style in the gynoecium, and despite of the fact that its grandfather Gijnlim sometimes harbors andromonoecious plants, it never showed a single berry in more than 15,159 plants in various hybrid trails that were evaluated in the period 1998-2007. It was decided to create a mutant version of K323 that acquired the hermaphrodite trait as the result of a changed GDS mediated by irradiation mutagenesis. The decision to provide another example in which a mutation in a GDS results into a plant with the sex linked hermaphrodite trait was made because this hybrid poses excellent starting material for mutagenesis. The first reason is that this hybrid has no tendency at all to produce berries even under circumstances that could have favored andromonoecy, such as short day and cold temperature (Franken, 1970) and plant age for which the tendency of andromonoecy peaks at three years (Franken 1970). Such circumstance should have occurred during the long period of evaluation of K323 in any case. A second reason is that all plants of this hybrid are genetically identical because it results from a cross between two doubled haploid parents. Therefore any phenotypic change in a plant belonging to hybrid K323 must be the result of mutation.

To create mutations, 34,000 seeds, obtained by bee pollination in an isolated greenhouse, were exposed to Cobalt-60 gamma irradiation at a dose of 450 Gray at the Synergy Health facilities (Synergy Health Ede B.V. Morsestraat 3. Ede, The Netherlands) using their 'test apparatus'. In this apparatus, the Cobalt-60 source is composed of pencil type rods that are arranged concentrically to a cylindrical container in which the sample can be placed. Seeds were provided in petri dishes that were piled in this container and exposed to the indicated dose of 450 Gray. The dose delivered was measured by a typical dosimetry system that involves the use of Perspex to measure a colorimetric change caused by the dose.

Figure 12B:
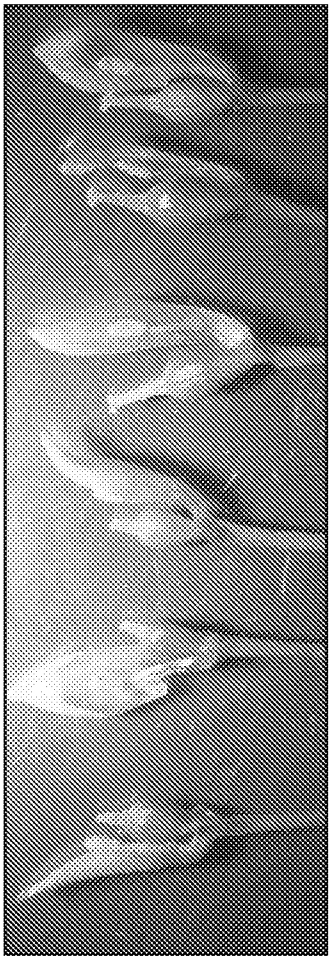
Figure 12C:
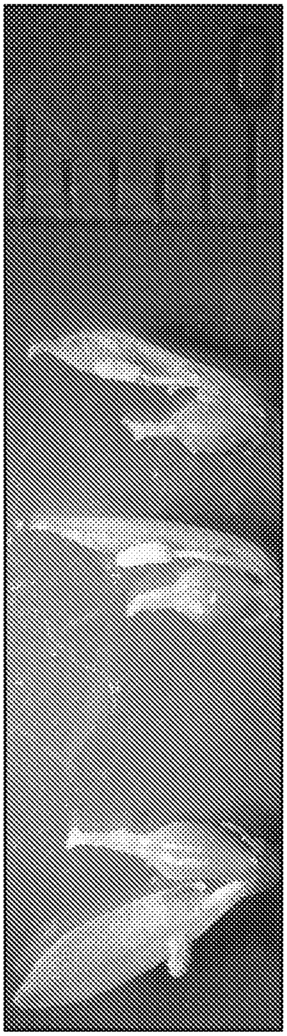
Figure 12A:

Irradiated seeds of K323 were sown outdoors in Horst, The Netherlands, in May 2012 and the first flowers were observed and inspected the next year from April 2013 until July 2013. It was estimated that roughly half of the seeds finally provided mature plants meaning that about 17,000 flowering plants have been evaluated. A single plant was found that showed a stalk bearing berries that appeared to have developed from each flower. In addition, this plant had a second stalk that produced perfect flowers. Consistent with previous observations, all of the other K323 plants did not produce any berry. The single hermaphrodite K323 plant, designated 'K323-G033' or shortly 'G-033' was transferred to an insect free greenhouse and further grown in a pot filled with turf where it produced new stalks all of which showed perfect flowers followed by full fruit set. An example of the fruit set is shown in FIG. 12-A. The typical flowers of K323-G033 compared to flowers of a wild-type (WT) K323 plant grown under similar greenhouse conditions are shown in FIG. 12-B. The flowers of G033 have a longer style and better developed stigma lobes that are longer and more curved compared to the WT K323 flowers. Later in the season, at short days, which has been shown to favor andromonoecy in other hybrids (Franken 1970) the most perfectly looking flowers of WT K323 plants were collected and again compared with G033 to find out if their best developed style and stigma could reach the level observed in the mutant (FIG. 12-C). The average style length of the mutant G033 was 2 millimeters, whereas the \VT K323 plants maximally produced styles of 1 millimeter. Clearly, a mutant had been created that showed flowers that were more perfect compared to the WT version of the hybrid and showed full berry set which plants of the WT hybrid and its father never did.

The mutant analyzed verified with proprietary microsatellite markers which confirmed its expected authenticity; it showed the unique microsatellite profile that is highly discriminative and characteristic for this hybrid from which this hermaphrodite phenotype has been obtained (results not shown). It was decided to sequence both Wild type K323 and its derived hermaphrodite plant K323-G033 in order to compare their sequences and to find out which gene mutation caused the hermaphrodite phenotype. The sequences were aligned to a genome reference sequence, which was composed by the laboratory of Dr James H Leebens-Mack, which in collaboration with the Beijing Genomics Institute (BGI) has worked on a draft genome sequence of doubled haploid super male DH00/086 (version 1.0). in their work sequence reads were mapped to an assembly of 100-90 bp paired end-and mate-pair Illumina sequences obtained from BGI for a total 163 gigabases of sequence and an approximate coverage of 123×. The resulting assembly constructed by bioinformaticians at the Beijing Genomics Institute, using a SOAP assembler, exhibited a contig N50 of 21,179 bp and a scaffold N50 of 301,040 bp. In other words, half of the genome is assembled in 1196 sequence scaffolds that are at least 301,040 bp in length.

The Beijing Genome Institute (BGI) further generated nearly 40× genome coverage of 100nt paired-end Illumina short reads for the DH00/94 female doubled haploid, a sibling to the DH00/086 male doubled haploid individual that was used for genome assembly and annotation.

Short reads from both G033 and WT K323 were aligned to the reference genome using bwa-mem with default settings (Li and Durban, 2009). Concurrent alignments were produced with Bowtie2, requiring end-to-end read alignments with no soft clipping or split-read alignments allowed Leaf tissue from G033 and a wild-type K323plant were similarly sequenced in the Leebens-Mack lab, generating roughly 7× whole genome shotgun coverage (Illumina paired-end 100nt reads) for each library. Reads from both libraries were aligned to the genome using bwa-mem. Read coverage at every non-transposon genomic feature from the initial BGI annotations produced with GLEAN (eg., whole gene, mRNA, individual exon, CDS, UTR) was counted for both libraries using bedtools coverageBed. Under the hypothesis that gamma irradiation induced a deletion in the G033 plant, data were sorted to identify gene features with 0 read support in the G033 plant and ≥5 reads in the K323 plant, then further sorted to identify gene features with the greatest read coverage difference between the two individuals.

By using this method, a variant sequence, potentially greater than 2 kilo-base pairs, was identified that was unique to the genome sequence of G033. A CDS exon positioned on a sex-linked BAC assembly (M-locus_scaffold4) at positions 2201:2926 had 18 aligned K323 reads and 0 aligned G033 reads. Read coverage was visualized within a Jbrowse genome browser instance. There was strong support for a border of this variant indicated by bwa-mem soft-clipped reads at a single location in 5 reads, shown by arrows at the right side of reads in FIG. 4. The exact size of the variant is unknown given the lack of read support to identify the other border (see further explanation below). More than 200 kb of surrounding genomic sequence was deemed to be hemizygous (Y-specific) by the presence of DH00/086 read coverage and the lack of DH00/94 read coverage.

It can be inferred from the Jbrowse visualization (FIG. 4) that in the genomic region represented by the scaffold M-locus_scaffold 4 (and similarly in the genome scaffold 905) an event has taken place that caused a lack of reads for mutant hermaphrodite G033 in a region that overlaps a large part of the predicted intron, the predicted second exon and in addition a large part of the transcribed sequence that may include a possible third exon (as predicted by EVM) of a DUF247 containing gene. The two distinct gene predictions are visualized in FIG. 4. The sequences of these gene predictions may be found in FIGS. 4 and 13.

Figure 4:
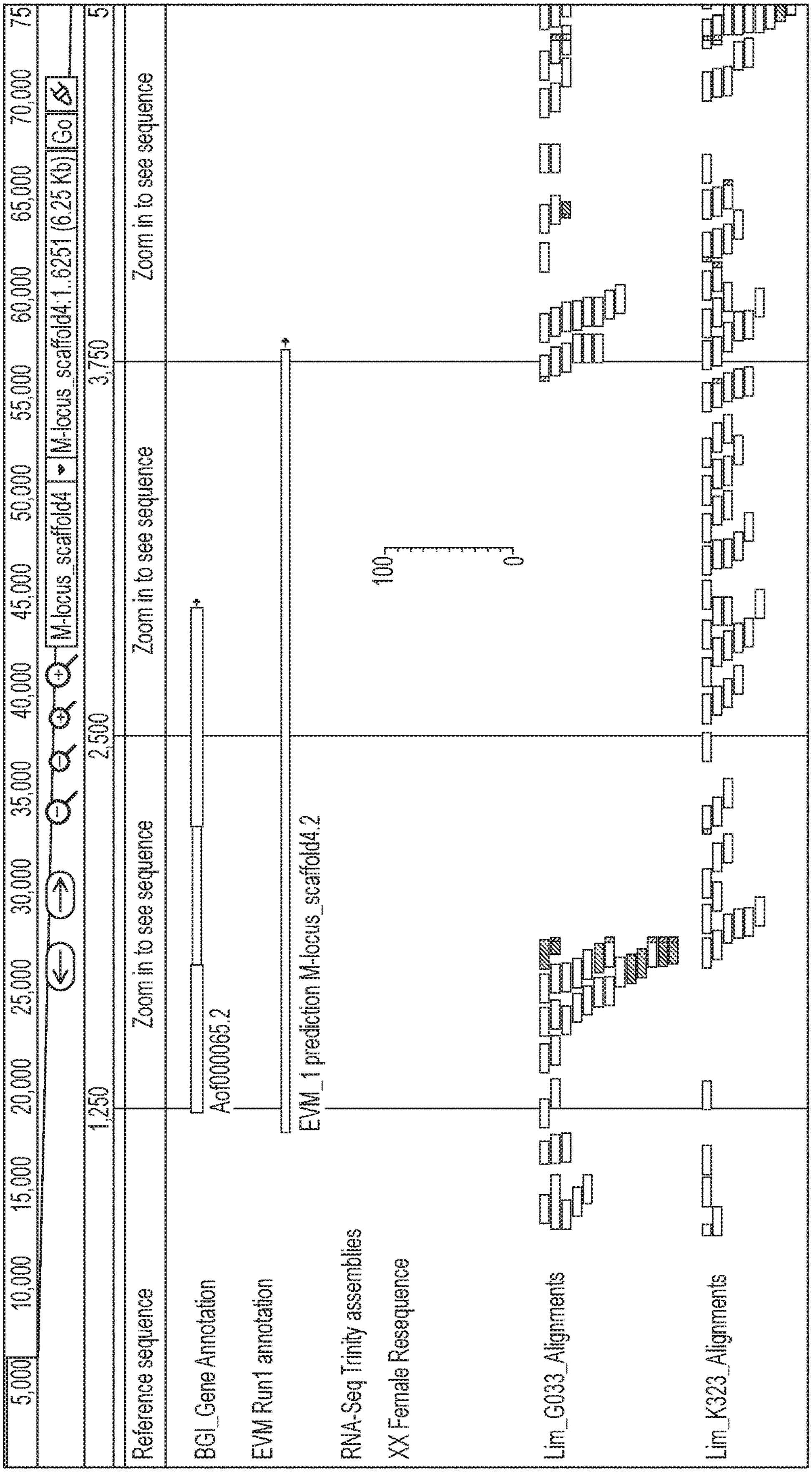

At the left border from the alignment where reads were lacking for G033 so called 'clipped reads' were found (indicated by arrows in FIG. 4). These reads were retrieved from the library sequence data and their entire gene sequences makes them 'split-reads'. In those split reads, one area (left, relative to the part were reads or missing in G0033) shows homology to M-locus_scaffold4 (sequence depicted in FIG. 13), whereas the other area at the right is identical among these reads but consistently different from the M-locus_scaffold4. Based on these split reads, a consensus sequence could be made which showed and suggested that at the position of M-locus_scaffold4 an insertion has taken place that replaced the original sequence. The split-read consensus of this insert in intron close to the exon 1 side of the intron is:

TCTGCAAGAACAAGGTAAGGAATGTTAAT-
GAAATCTAAATCTTCATACCTT-
GAAATGTCCCAGCTGTAAC
TCCAGAAGAACTTGCACAAAATTTCCTTATTCCTT-
ATTCCTTATTCCTTGCAGTTATATACGTTATAGC
GGATC (SEQ ID NO: 110), where the underlined part indicates the insertion specific part.

Using this underlined part as a query to mine the sequences data of the G033 library, mate pair sequences were identified that provided a consensus sequence that extended further into the inserted part. This sequence consensus was:

TNNNNNNNNNNNNNNNNNNNNNNNNNNNNNNN
NNNNNNNNNNNTTATATACGTTATAGCGGATCC-
CATCC ATCGGCTC-
CAAAGCTTCGGCCAGCTGTCGAGCAA-
GACGTTGACGCTGTCTTTGTCGTGCTCTCTTTGATA
ATGCCGGAGCGTCTTCAGAAGTC (SEQ ID NO: 111), where the N's denote unknown bases.

Figure 11:
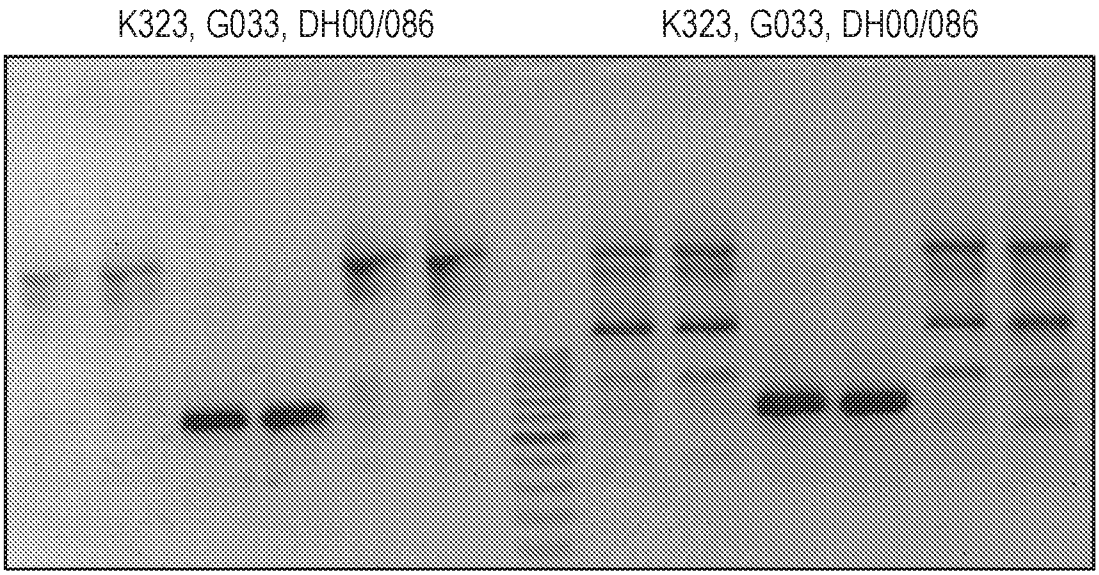

Two reverse primers, designated CN83 and CN84 (see primer Table 3) were designed that anneal to the sequence of the alleged insertion and point towards the first exon. These primers combined with the exon 1 specific primer CN78 were tested in a PCR to confirm that all short sequences collected so far for G033 indeed provide a correct representation of the border of an insert. The template sequences that were used were the sequences of K323-WT, hermaphrodite G033, and DH00/086 where the last template represents a sample corresponding to the reference genome. A unique fragment was obtained for mutant G033 that can be used as a genetic marker (See FIG. 11) that was lacking in the K323-WT plant and in the reference genome sample. The Sanger sequences obtained by sequencing this fragment are shown in the following sequence

```
                                    (SEQ ID NO: 112)
CCTTCGTATGGACGTCATAAACACAGGGCGCTACTGAACTTCCTCATCCG

ATGTCAAGTGTCGATCCATGACATCATACGAGCCCTGAGGAAGAACCTGC

ACGATTTCAGAGCCTGCTATCAAGATCTTGACACCTTTTGGATGAAGAAT

GATGATGAGTTCCTAAAAATCATGATTTACGATGGGGCTTTCATGATTGA

AATCATGATAGCGACCGTTGAACCATATGAGCGCACACCTTCTAGCTATC

ATGCCAAGGACCCAATATTCAAGAAGCCATACTTGGTCGAAGATCTTCGT

GTAGATATGCTCAGGTTGGATAATCAAATTCCAATGAAGGTCCTGGAGAT

ATTGTCTAAATTCTGCAAGAACAAGGTAAGGAATGTTAATGAAATCTAAA

TCTTCATACCTTGAAATGTCCCAGCTGTAACTCCAGAAGAACTTGCACAA

AATTTTCCTTATTCCTTATTCCTTATTCCTTGCAGTTATATACGTTATAG

CGGATCCCATCCATCGGCTCCAAAGCTTCGGCCAGCTGTCGAGCAAGACG

TTGACGCTGTCTTTGTCGTGCTCTCTTTGAT
```

Figure 5A:
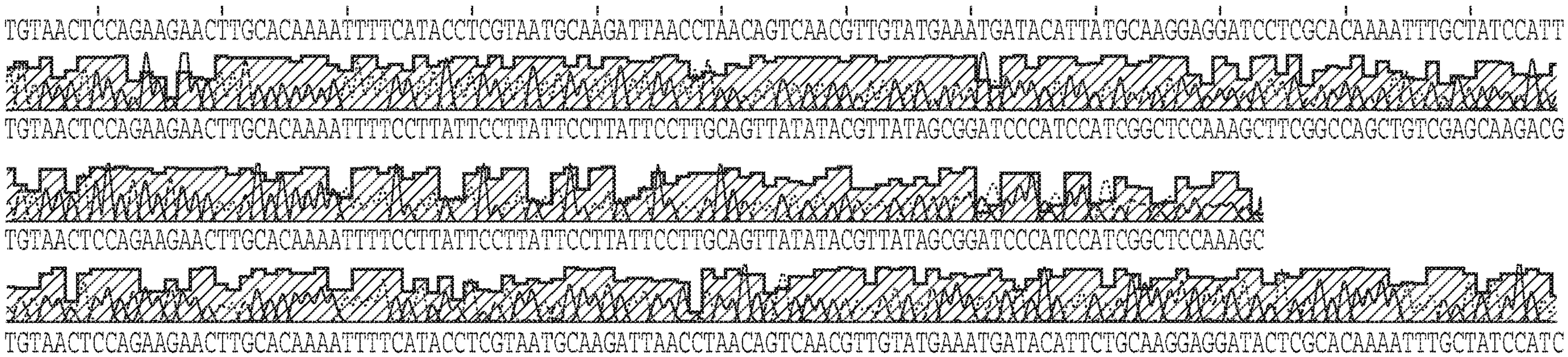
Figure 6:
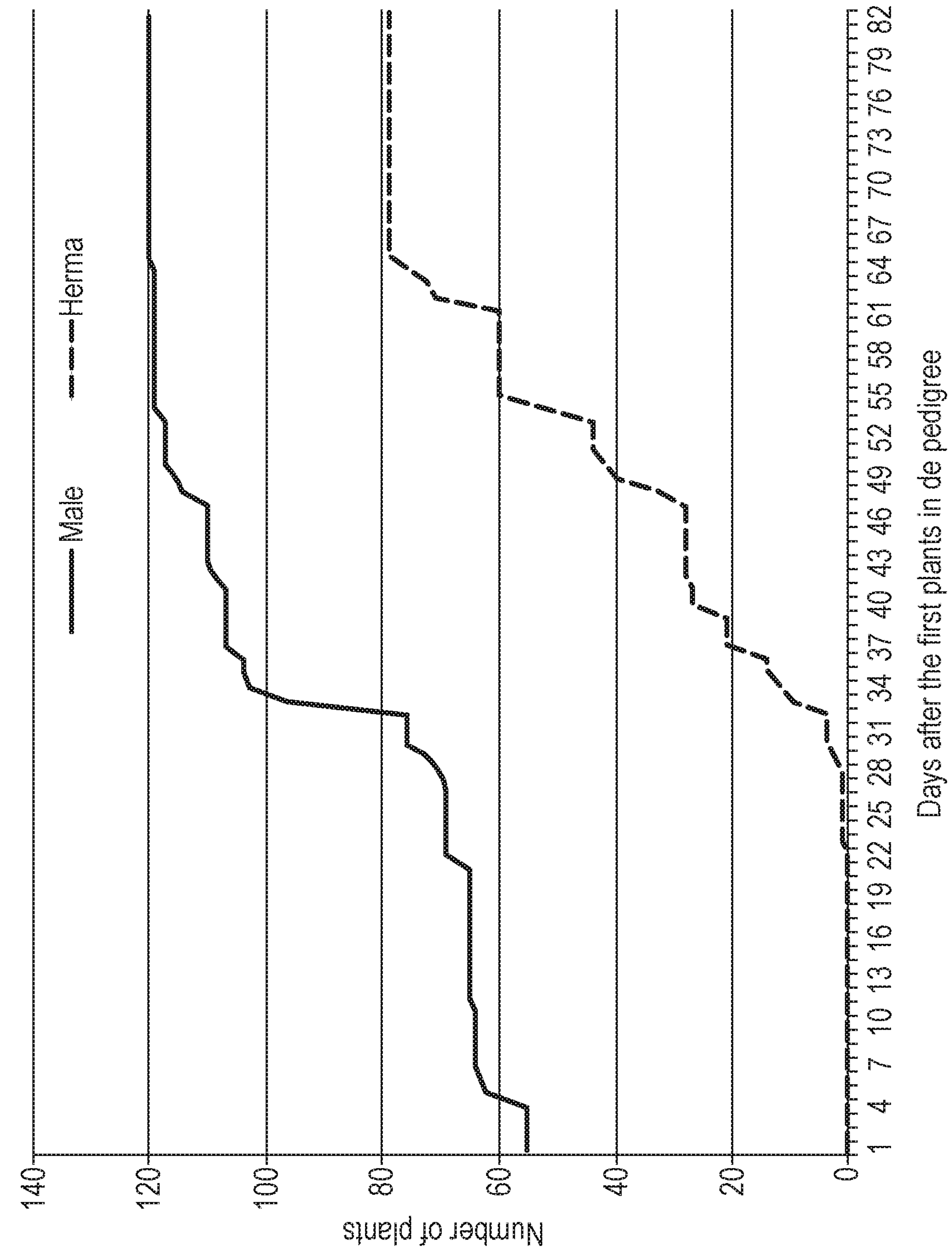

The alignment of this sequence in the predicted intron is shown in FIG. 5. Sanger sequencing indeed proved that the fragment is 'chimeric' thus containing a sequence known to occur in the predicted intron, followed by a unique 'downstream' part that must have resulted from an insertion like event, probably best referred to as a 'replacement-insertion'.

Whatever the precise event may be, clearly the G033 mutant plants lacks reads in the predicted intron and the predicted exon 2 and exon 3 of the GDS gene (described in EXAMPLE 1) and thus has a disrupted GDS gene. Study of the read mapping in J-browse teaches that reads of G033 are lacking sequences further downstream the GDS gene. This downstream region comprises stretches of repetitive DNA, separated by low or single copy regions, which can be inferred from the read mapping of the female reference DH00/94 (described in EXAMPLE 1) that show some read mapping to certain sub-regions (comprising high copy DNA), disrupted by gaps in the read coverage because there are no female reads that can map to these truly unique and male-specific sub-regions of DNA. As expected, this 'patchy distribution' of reads is not observed for the reads of DH00/086 mapped to the same reference. It appears from studying the read mapping in genome browser J-browse that the reads obtained from G033 show a patchy read distribution, comparable to the distribution of female DH00/094, up to position 17,500 in Mlocus-Scaffold 4, whereas the read mapping of the K323-WT shows the typical continuous read mapping comparable to that of the DH00/086 reference male.

In conclusion, the outlook of the read mapping landscape suggests that the end of the missing part that resulted from the 'insertion-replacement event' in G033 is positioned from the GDS gene intron to a position roughly before 1.8 kb from the scaffold start. Further downstream of this latter position, a comparable depth of read mapping is observed for both G033 and the K323 WT control plant. In the region spanning the disrupted GDS gene up to the hypothesized end of the 'insertion—replacement event', three coding sequences can be found as identified by FGENESH. All three coding sequences have hits using BLASTx (Altshul et al., 1990) against non-redundant proteins such as Integrase, catalytic region; Zinc finger, CCM-type (ABD32582.1), Retrotransposon gag protein [*Asparagus officinalis*] ABD63142.1 and Retrotransposon gag protein [*Asparagus officinalis*] ABD63135.1. As these annotations were related to transposons, rather than plant genes, it was concluded that, similar to the mutation described for EXAMPLE 1, a hermaphrodite plant had been created by a mutation in the GDS gene.

To further investigate the segregation of the hermaphrodite trait of G033, several crosses were made. From the offspring the gender was recorded and the DNA was isolated for a later study of the co-segregation of the CN78/CN83 marker, indicative for the insertion-replacement event. Phenotyping was performed by both visual inspection of the flowers (typing these as either perfect/female/male) and by inspection of full berry setting under insect free conditions. The results obtained are presented in Table 4.

TABLE 4

Phenotypic segregation results obtained for three pedigrees (G033 self fertilized, GO33 crossed to a male DH and a female crossed to G033) made by using mutant G033 a-parental plant and their marker results. 'Marker present' means that a PCR fragment generated by primer pairs CN78/CN83 or CN78/CN84 that is diagnostic for the deletion/insertion event is amplified, thus is present, by using template DNA for the particular plants studied as has been shown from FIG. 11 (for further explanation see text).

| G033 self-fertilzed Aaff | female | hermaphrodite | male | no flowering | totals |
|---|---|---|---|---|---|
| marker present | 0 | 46 | 0 | 1 | 47 |
| marker absent | 8 | 0 | 0 | 14 | 22 |
| totals | 8 | 46 | 0 | 15 | |

| Aaff × AAFF G033 crossed to male DH | female | hermaphrodite | male | no flowering | totals |
|---|---|---|---|---|---|
| marker present | 0 | 0 | 10 | 0 | 10 |
| marker absent | 0 | 0 | 14 | 0 | 14 |
| totals | 0 | 0 | 24 | 0 | |

| aaff × Aaff female crossed to G033 | female | hermaphrodite | male | no flowering | totals |
|---|---|---|---|---|---|
| marker present | 0 | 53 | 0 | 0 | 53 |
| marker absent | 33 | 0 | 0 | 7 | 40 |
| totals | 33 | 53 | 0 | 7. | |

The progeny that was obtained from self-fertilization of G033, that would have an expected genotype Aaff resulted in 46 hermaphrodites and 8 females which significantly differs from the expected 3:1 ratio ($p<0.02$). An explanatory hypothesis for this deviation is that a number of plants had not been phenotyped during the growing season, which are likely females as female plants usually flower later than male plants (Lopez_Anido & Cointry, 2008, p89) and possibly also later than hermaphrodites. All but one of fifteen of the plants that have not flowered lack the diagnostic marker for the GDS gene mutation, which is consistent with linkage of the GDS gene to the hermaphrodite trait and the possible late flowering of the female plants. Further all hermaphrodites had the CN78/CN83 marker, whereas it was lacking in the eight females.

In a second cross, hermaphrodite G033 was emasculated and crossed as a mother plant to a male doubled haploid, which could be represented as a type of cross with the genetic constitution Aaff×AAFF. A pedigree of 24 male plants was obtained in which the marker diagnostic for the mutation in the GDS gene segregates in a 1:1 ratio (10:14). This is consistent with results presented in EXAMPLE 1, which again indicate that the dominant allele of the repressor of gynoecium development from the male parent blocks the previously observed gynoecium development of the hermaphrodite. It can thus be concluded that the hermaphrodite trait is a recessive trait.

In a third cross, a female was pollinated by the hermaphrodite to generate a progeny of 93 plants comprising 53 hermaphrodites and 33 females. This ratio significantly deviates from a 3:1 ratio and if it is assumed, as above, that the seven plants that have not yet flowered are female plants this deviation is even more extreme. However, the diagnostic marker for the 'insertion-deletion event' in the GDS gene fully co-segregates with the hermaphrodite trait which confirms the genetic model of a dominant gene that allows anther development in a pedigree devoid of the dominant gene that suppresses gynoecium development.

It should be noted that in all of the above crosses flowers of hermaphrodites were perfect from all of which berries developed.

In conclusion, it has been demonstrated that a disruption in the GDS gene at a male specific region has been created using irradiation mutagenesis. This mutated gene can be transferred to next generations and confers Mendelian inheritance of the hermaphrodite trait.

Example 3

Epi-Alleles of the DUF247 Domain Containing Female Suppressor Gene

When breeding line K1036 was seed propagated in an isolated greenhouse in which bees were placed for pollination, it was noticed that all plants had produced berries, whereas normally half of the plants expected to be male would not produce berries. Several years later, lot K1036 was sown again to unravel the inheritance of the hermaphrodite trait. Sixteen plants were evaluated for flowering and fruit set. All plants, which all had well developed anthers were capable of fruit set under insect-free conditions. It was noted that fruit set somewhat varied among those plants and/or among their branches. Despite of some failures in fruit set, the number of berries on a plant could reach a level as high as 95%, which is exceptionally high. As breeding records provided insufficient information on the number of generations breeding line K1036 has been propagated, five K1036 plants were genotyped using a set of thirty proprietary microsatellite markers which are used at a routine basis to monitor both authenticity and the level of inbreeding of breeding stock. The five hermaphrodites appeared fully homozygous at thirty (hypervariable) loci and were virtually identical (results not shown); four plants were fully identical and one plant differed from the other three plants at only two of the thirty loci for which it differed homozygously for alternative alleles. The level of homozygosity, observed for K1036 is usually only found for doubled haploids obtained by anther-culture. In conclusion; the hermaphrodite K1036 represents fully homozygous (syngeneic) inbred material.

Despite of the fact that the fruit set of some plants was as high as 95%, not all plants perfectly set fruit and some plants lacked berries from tens of flowers. Because the plants were found to be virtually syngeneic, differences in fruit set were initially attributed to non-uniform growing conditions such as plants shading other plants on tables, plants poorly growing after re-potting, insufficient watering, pollination under warm weather conditions etc. To further analyze the phenomenon of incomplete fruit set, several K1036 hermaphrodites were crossed with two (line 88 and line 105) female testers. All resulting F1 plants obtained by these test crosses produced anthers and all plants were capable of producing berries under insect-free conditions. Fruit set was scored into classes 1-5 which roughly correspond to 0-20%, 20%40%, 40%-60%, 60%-80%, 80%400% fruit set. It was observed that most F1's were highly hermaphrodite (class 5) as if all F1 hybrids inherited the trait that was essentially fully penetrant. However, again some poorly fruit setting plants were noted among plants within F1 pedigrees and one small F1 progeny stood out for a much lower fruit set (867F1b, that has father plant with ID 215292) as if there might be a heritable factor different for this particular F1 progeny. The fruit set of the F1 testcrosses is shown in Table 31. In another experiment the fruit set of pedigrees obtained from individual self-fertilized K1036 hermaphrodites was recorded. These results are shown in Table 32. These results again indicate that families seem to segregate in terms of fruit set and that the average fruit set differs between pedigrees. However, when one looks at fruit-set of particular K1036 father plant Ills as the result of self-fertilization and compares this fruit set with the fruit set of the female testcross pedigrees sired by those particular individual K1036 father plant ID's, there seems no clear correlation. (see Table 31 and Table 32 for similar 21529× ID's).

TABLE 31

The fruit set, on a scale of the F1 testcrosses derived from K1036 father plants pollinating a female tester (either line 88 or lin 105). Fruit set was scored into classes 1-5 which roughly correspond to 0-20%, 20%-40%, 40%-60%, 60%-80%, 80%-100% fruit set (berries)

| | | father K1036- | Number of plant per fruit set scale 1-5 | | | | | | fruit set |
|---|---|---|---|---|---|---|---|---|---|
| F1 ID | mother | ID | 1 | 2 | 3 | 4 | 5 | average | father |
| 876F1a | 88 | 215290 | 0 | 1 | 1 | 2 | 28 | 4.8 | nd |
| 876F1b | 88 | 215292 | 2 | 1 | 3 | 1 | 2 | 3.0 | 1 |
| 876F1c | 88 | 215293 | 0 | 0 | 0 | 0 | 7 | 5.0 | 4 |
| 877F1a | 105 | 215296 | 1 | 0 | 1 | 2 | 35 | 4.8 | nd |
| 876F1e | 88 | 215297 | 0 | 0 | 0 | 1 | 53 | 5.0 | 4 |
| 876F1f | 88 | 215299 | 1 | 0 | 0 | 0 | 34 | 4.9 | 3 |

TABLE 32

The fruit set, on a scale of the of F1 plants derived from selfing particular K1036 plants indicated by their plant ID. Fruit set was scored into classes 1-5 which roughly correspond to 0-20%, 20%-40%, 40%-60%, 60%-80%, 80%-100% fruit set (berries

| | Fruit set 1-5 | | | | | | fruit set |
|---|---|---|---|---|---|---|---|
| selfed K1036 ID | 1 | 2 | 3 | 4 | 5 | average | father |
| 215290 | 5 | 2 | 1 | 1 | 0 | 1.8 | nd |
| 215293 | 4 | 0 | 6 | 16 | 8 | 3.7 | 4 |
| 215295 | 3 | 2 | 3 | 4 | 0 | 2.7 | 4 |

TABLE 32-continued

The fruit set, on a scale of the of F1 plants derived from selfing particular K1036 plants indicated by their plant ID. Fruit set was scored into classes 1-5 which roughly correspond to 0-20%, 20%-40%, 40%-60%, 60%-80%, 80%-100% fruit set (berries

| | Fruit set 1-5 | | | | | | fruit set |
|---|---|---|---|---|---|---|---|
| selfed K1036 ID | 1 | 2 | 3 | 4 | 5 | average | father |
| 215296 | 1 | 2 | 3 | 2 | 11 | 4.1 | nd |
| 215297 | 2 | 1 | 0 | 4 | 0 | 2.9 | 4 |
| 215299 | 3 | 4 | 2 | 2 | 9 | 3.5 | 3 |

Figure 14:

It therefore remained questionable whether the observed variability was heritable or largely controlled by the environment. To further analyze the genetics, an emasculated hermaphrodite K1036 plant (ID 215297) was crossed to a super-male (line 88 doubled haploid, designated D1402/504). This cross yielded three F1 hybrids (designated 861F1-124M, 861F1.126M, and 861F1.128M) which were all fully male, which means that those plants all had fertile anthers and did not produce any berries. This indicates that the hermaphrodite trait originating from K1036 is recessive to the male trait of super male DH02/504. The fact that test crosses between K1036 and female plants yielded hermaphrodites, whereas a cross with super-male plants only yielded males suggested that K1036 might be lacking a female suppressor as has been found for the hermaphrodites of EXAMPLE 1 and EXAMPLE 2. To further investigate this, the hermaphrodite×super-male F1 hybrids were backcrossed to line 88 female plants. Pedigree 861BC1d, which was a cross between individual female 88-100599 and individual 861F1-124M, was phenotyped for fruit set and flower morphology and genotyped using sex linked markers. Genetically, this is a pseudo-testcross of the type: inbred line-88 female×(hermaphrodite K1036 inbred line-88 super male). A total of 91 plants could be sex-typed of which 53 were male and 38 were hermaphrodite which is not significantly different from a 1:1 ratio (p>0.11) Marker AO022 has three recombination events in 91 samples tested and marker Asp_80 (for primers see Table 3, EXAMPLE 1) showed only two recombination events among 85 individuals tested. This shows that the recessive hermaphrodite trait is linked to the M-locus as has been found for hermaphrodites of EXAMPLE 1 and EXAMPLE 2. As opposed to other pedigrees derived from K1036 which showed some variability in fruit set, there was no marked variation among hermaphrodites in this particular pedigree 861BC1d; all hermaphrodites showed nearly perfect fruit set and had the maximum fruit set score of '5'. All hermaphrodites of pedigree 861BC1d showed a well-developed style that would he scored as a four or five using the classification of Franken, 1969 p37. In all males of pedigree 861BC1d, the style was lacking and none of these males produced any berries and thus were not even slightly andromonoecious. Examples of the two flower phenotypes that segregated in 861BC1d and are representative for the segregating phenotypes in this population are shown in FIG. 14. In conclusion, the hermaphroditism originating from K1036 and segregating in pedigree 861F1d was a clear mono-genic recessive trait, linked to the M-locus.

Because the hermaphrodites of EXAMPLE 1 and EXAMPLE 2 showed an single nucleotide deletion and a large insertion deletion, respectively, in the M-locus linked GDS gene, a mutation was also expected for the K1036 hermaphrodite M-locus GDS allele. Sequencing PCR fragments in both directions using K1036 as template DNA and using primer pairs, CN67/68, CN67/CN82, CN59/CN70, CN69/CN81, CN59/CN60 (see Table 3, EXAMPLE 1) however, revealed no unique sequence variation. K1036 shows a GDS gene haplotype that is characterized by a SNP at the third codon position of a serine amino-acid (AGC to AGT) at the 58th amino-acid of the second predicted exon) which is a synonymous substitution (thus a silent mutation which retains the serine amino-acid) that can also be found in breeding line 9M (for sequence of 9M see FIG. 13) that is male (rather than hermaphrodite) indicating that this particular SNP has no impact on sex determination. This particular SNP was later exploited as genetic marker target (see below).

The M-locus linked GDS gene sequence of hermaphrodite K1036 and male 9M were found to be fully identical. Efforts to obtain sequence information upstream the M-locus-linked-GDS gene for mutations that may differentiate the K1036 from 9M haplotypes have failed (results not shown) which likely depends on the nature of this sequence. Three PAC Bio reads which overlap the unknown region upstream the GDS gene towards a DUF4283 containing gene located further upstream scaffold 905 were provided (results not shown). Information obtained by these PAC BIO reads suggest that the region upstream the GDS gene is highly repetitive and harbors large AT repeats or large AT-rich repeats interspersed by short GC-rich repeats which makes it impossible to design primers that would allow Sanger sequencing of the sequence upstream the GDS gene (that may include the gene promotor or other cis-regulatory elements) for both K1036 and 9M (results not shown), Long distance amplification using primers, flanking the 'sequence gap' provided fingerprint-like patterns or fragments that were not authentic as these fragments were also amplified in PCRs lacking one of the two primers initially used as a pair; results not shown. In conclusion, it was impossible to obtain sequence information upstream the M-locus linked GDS gene.

To find out whether new efforts to detect sequence variation near the GDS were worthwhile, thus that a mutation in line K1036 indeed should be sought in the M-locus linked GDS gene (region), efforts were taken to further fine-map the K1036 hermaphrodite trait. To this end, more '861-BC1 crosses' of the type: inbred line-88 female×(hermaphrodite K1036×inbred line-88 super male) were made. Optimal greenhouse use required that the population was downsized by selecting and keeping only young plants that had a recombination event between microsatellite markers AO022 and Asp-80 (for marker details see EXAMPLE 1) which flank the M-locus linked GDS gene at both sides at a genetic distance of less than 5 centi-Morgan. Those 'marker recombinant plants' were subsequently phenotyped for flowering and fruit set. In addition to markers AO022 and Asp-80, plants were genotyped for their GDS allele by Melting Curve marker CP80/CP81 (for primers see Table 3). This marker targets the SNP in the second predicted exon of the GDS gene of hermaphrodite grand-parent K1036 which differs from the allele of the other grand-parent DH02/504, the line 88 super male.

For the populations 861BC1a, 861BC1b, 861BC1c, 861BC1e, and 861BC1f; 22, 327, 135, 86, and 33 individuals were grown, respectively, from which 18 recombinants between marker AO022 and the GDS gene locus and 8 recombinants between the GDS gene locus and Asp_80 were obtained for further phenotyping. Those recombinants, together with some 'control plants' (for which AO022, GDS, and Asp_80 did not recombine), provided a panel of 44 plants that was further phenotyped in the next season.

Twenty-five of the plants in this panel, which had the GDS allele originating from the DH02/504 male grand-parent, were not capable of producing berries. All those twenty-five plants had style lengths that would be classified as 1 (no style at all) in the scale of Franken, 1969; p37. In conclusion, if a BC1 plant received the DH02/504 male grand-parent M-locus GDS allele, it was a male plant. Nineteen plants in the panel had the K1036 hermaphrodite grand-parental M-locus GDS—allele. Among these nineteen plants variability has been observed: Twelve plants produced over five-hundred berries and these plants had styles qualified as either a '5' (n=9 plants) or a '4' (n=3 plants). Two plants produced roughly 200 berries and had styles classified as '5' or '4'. Another two plants produced roughly 100 berries and had styles classified as '3' and '2'. Three remaining plants, which had a style classified as only '1', produced only five berries (n=1 plant) or no berries at all (n=2 plants). One plant that was incapable of fruit set, which carried the K1036 hermaphrodite grand-parental M-locus GDS allele, was a 'control' hermaphrodite rather than 'a marker recombinant' which indicates that the phenomenon of variable fruit set was not per se related to recombination events in the M-locus region but generally occurred in this population.

In conclusion, in the additional 861BC1 pedigrees no fruit set was observed among plants that carry the DH02/504 male grand-parent M-locus GDS allele which were all male (just like in pedigree 861BC1d), whereas among plants that carry the K1036 hermaphrodite grand-parental M-locus GDS allele, all but two plants set fruit. However, variability was observed for the level of fruit set among those plant which set fruit. This fruit set appeared to be related to how well the style was developed. This situation, observed for the additional 861BC1 (861BC1a-f other than 861BC1d) pedigrees is different compared to the results obtained for pedigree 861BC1d, because in the latter population an invariably high level of hermaphroditism was observed among all plants (thus without exceptions) that carried the K1036 hermaphrodite grand-parental M-locus GDS allele.

In EXAMPLE 1 and EXAMPLES 2 it has been shown that a recessive allele caused the loss of a normally dominant female suppressor GDS Results obtained for pedigree 861BC1d in the present EXAMPLE were consistent with that model, although the cause of loss of function has not become clear. For the other 861BC1 pedigrees, phenotypes have been found which suggest incomplete penetrance of the K1036 hermaphrodite grand-parental M-locus GDS allele which likely must be interpreted as an 'incompletely lost' or 'incompletely suppressed' female suppressor GDS gene'.

In a later period that overlapped the periods of phenotyping of the previous pedigrees, another 861BC1 pedigree, designated '861BC1j', was genotyped for two markers. The first HRM-marker was located in a A20/AN1-like zinc finger family protein gene, shortly 'A20/AN1-like' (primers CM45/CM46, see Table 33), which replaced marker AO022, and the second marker was Asp_80 (CK63/CK64, Table 3 EXAMPLE 1)

At the time progeny 861BC1j was evaluated for berry set it was largely unknown that some pedigrees may show a genetically determined, rather than an environmentally controlled, variable number of berry set and fruit set for those plants was roughly scored as capable or incapable of fruit set, rather than assessed quantitatively.

A number of 142 plants was found that were 'non-recombinant' for the K1036 hermaphrodite grand-parental allele for markers 'A20/AN1-like' and Asp_80 flanking the GDS locus. Of those 142 plants; 118 produced berries and 24 plants did not set fruit. A number of 135 plants was found that was 'non-recombinant' and had the DH02/504 male grand-parental allele for markers A20/AN1-like and Asp_80 flanking the GDS locus, all of which were male and produced no berries. Six marker recombinants showed a phenotype that was expected based on their typed GDS allele.

The 24 plants that, despite of their alleles, which were of K1036 hermaphrodite grand parental origin, did not produce berries, were kept for phenotyping in the next season together with eight hermaphrodite 'control plants' and eleven male 'control plants' (these control plants showed phenotypes consistent with their marker alleles A20/AN1-like and Asp_80 originating from hermaphrodite K1036 and male DH02/504 grand-parents, respectively) together with three plants that had not been phenotyped before, one plant that had recombination event between A20/AN 1-like and the GUS gene and four that showed a recombination event between the GDS gene and Asp_80.

In this next evaluation, the number of berries as well as flower morphology were determined more carefully. The eleven male control plants again produced no berries at all and they had ill-developed styles (score 1). The plants expected to be hermaphrodite based on their grand parental alleles of markers linked to the GUS locus showed variability in fruit set and flower morphology. Of 36 plants that had the K1036 hermaphrodite grand-parental GDS allele, six plants produced over 100 berries, six produced 25-65 berries, seven produced 1-18 berries and the remainder produced no berries at all.

This again showed that the loss of female suppression of the K1036 grand parental GDS allele was incomplete in this pedigree.

To find out whether the GDS allele originating from K1036 could be an epi-allele, as has been found for sex-determination in melon (Martin et al., 2009), it was decided to obtain bi-sulfite sequencing data for hermaphrodite K1036, the reference genome of male DH00/086 and for line 9 male which has the same GDS haplotype as K1036 (because of shared SNPs). Below the materials and methods are described that were used to obtain the data:

Libraries

Illumina sequencing libraries were prepared from bisulfite converted DNA. Following bisulfite conversion unmethylated cytosines were converted to uracil whereas 5-methylcytosines remained intact. Following PCR-amplification the converted nucleotides yielded a thymine whereas the non-converted nucleotides remained as cytosines.

For each library, 2 μg of total DNA were sonicated to ~550nt using a Covaris-S2. End Repair was performed using the End-It Kit (Epicentre) according to manufacturer's instructions. The reaction was cleaned using 0.8× AmpureXP beads. A-tailing was performed using Klenow (3' to 5' exo minus, NEB) and incubated at 37° C. for 30 minutes. The reaction was again cleaned using 0.8× AmpureXP beads. NextFlex sequencing adapters were ligated onto each A-tailed fragment using T4 DNA ligase (NEB) and incubated at 16 C overnight. The ligation reaction was cleaned twice using 1× AmpureXP. Bisulfite conversion was performed using the MethylCode kit (Life Technologies) according to manufacturer's instructions. Bisulfite-treated DNA was amplified with Kapa Uracil+2× Readymix according to the following protocol: 2 min at 95° C., 30 sec at 98° C., followed by 4 cycles of [15 sec at 98° C., 30 sec at 60° C. and 4 min at 72° C.] ended by 10 min 72° C.

The amplified bisulfite libraries were again cleaned using 1× AmpureXP and sequenced with paired-end 150nt reads on an Illumina NextSeq500.

Bioinformatics

Paired end Illumina reads were mapped to the *Asparagus* 2.0 reference genome (source) using BWA-meth (Pedersen, 2014) with bwa-mem (Li, 2013) version 0.10 using the following command line (/usr/local/bin/bwameth.py—reference . . . /Genome/02.assembly_result/V2.0/Asparagus.V2.0.genome.fa-t10—calmd-p DH0086 DH0086_bisulfite_1.fq.gz DH0086 bisulfite_2.fq.gz). bwa-meth creates two computationally converted reference sequences, one for the forward or Watson strand in which all cytosines are converted to thymines and one for the Crick or reverse strand, for which all guanines are converted to adenines. Read pairs were mapped to both computationally converted genomes, when a pair was mapped to the Watson or Crick strand with a mapping score higher than 40 the pair was retained. When a pair matched both the Watson and the Crick strand only the highest scoring pair was retained. A custom read group tag in the resulting BAM alignment file "YD:Z:f" identified read pairs mapped to the Watson strand whereas "YD:Z:r" identified reads mapped to the Crick strand. Based on these tags, reads were split into Watson mapping and Crick mapping pairs using the following bash command: "samtools view-h all.bam |tee>(grep "^@\|YD:Z:f"C|samtools view—Shb→Watson.bam)|grep "^@\|YD:Z:r"|samtools view—Shb→Crick.bam". Samtools (http://www.htslib.org/download) version 1.2 was used.

Following mapping, a custom python script was created that iterated over all nucleotides in the genome. Creating such a (python) script can be achieved by any competent bioinformatician familiar with the art. For all cytosines on both the Watson and the Crick strand the correct context, CG, CHG or CHH (where H is C, A or T) was determined. A nucleotide is considered to be in CG context even if the base following this dinucleotide pair is also a G, so the first nucleotide in the sequence "CGG" is considered to be in CG context on the Watson strand. The cytosine opposite to the G on the second position, which resides on the Crick strand, is also considered to be in CG context, as the 3' downstream nucleotide on the same strand here is a G. Similarly, the cytosine opposite to the third G is considered to be in CHG context, as the first 3' downstream nucleotide on the Crick strand is a C, whereas the second 3' downstream nucleotide on that strand is a G. Methylation levels were determined for the Watson and Crick strand separately by counting the number of unconverted versus total nucleotides. On the Watson strand, converted nucleotides are represented by thymines (T) with a reference nucleotide C whereas on the Crick strand converted nucleotides are represented as adenines (A) with a reference nucleotide G. Using samtools (version 1.2) pileup the per-position conversion rate was calculated for cytosines on both Watson and Crick strand simultaneously. Methylation was only called for position for which no nucleotide polymorphism was evident. Methylation polymorphisms can be distinguished from nucleotide polymorphisms (SNPs) because in case of the latter both Watson and Crick strand show evidence of a polymorphism whereas a methylation polymorphism is only present on either the Watson or the Crick strand. This is due to the fact that bisulfite conversion only affects cytosines, leaving the guanine on the opposite strand intact. Given sufficient read mapping coverage on both strands methylation polymorphisms can thus be distinguished reliably from nucleotide polymorphisms.

Results

Figure 15:
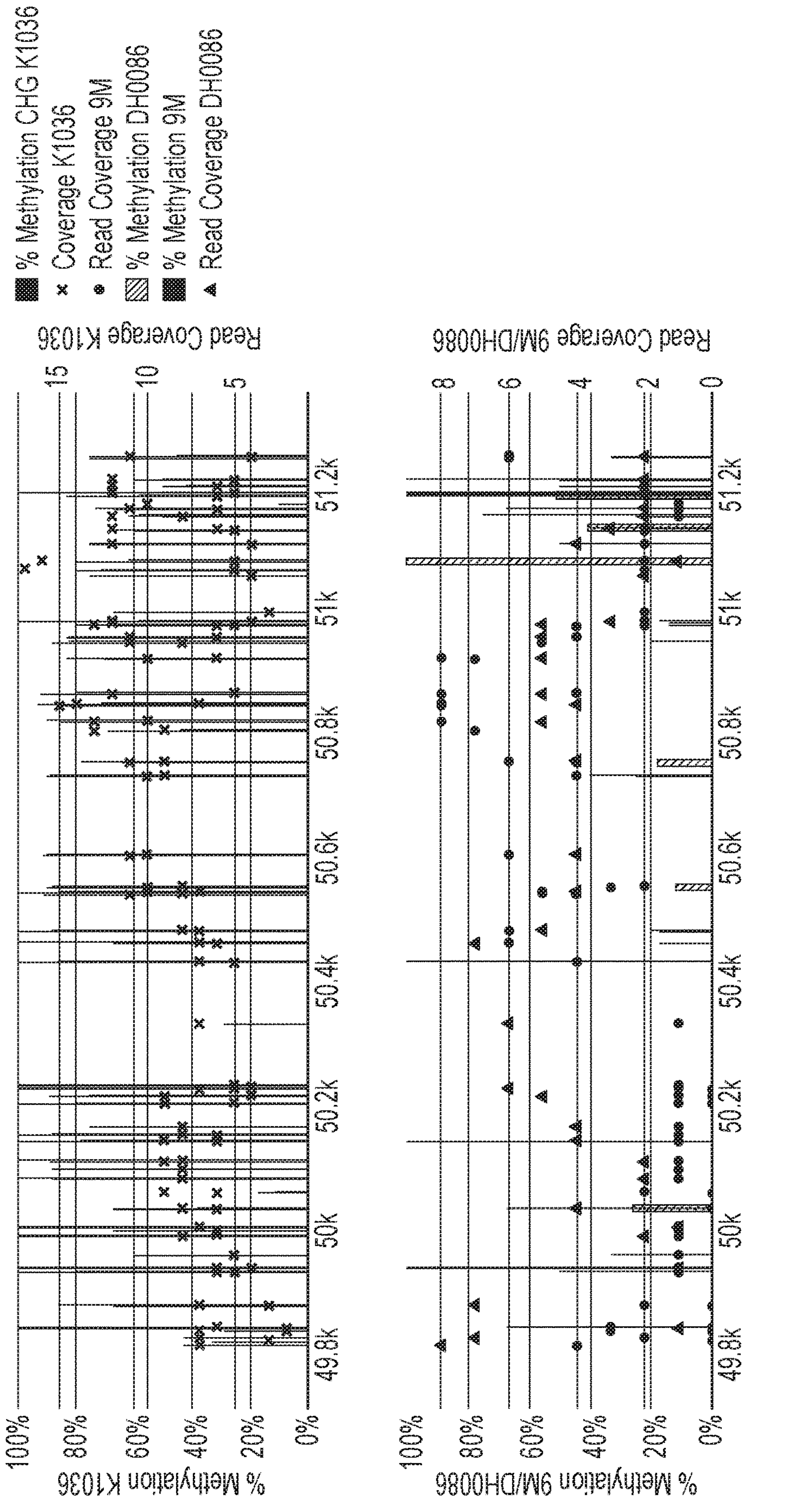

The M locus linked gene with the name "Aof030575.3" (indicated by the coding region of SEQ ID NO: 1 (see EXAMPLE 1) located on Scaffold_905 *Asparagus* Version 2.0 reference genome having a DUF247 domain showed striking differences in CHG methylation between K1036 and DH00/086 in a 1434 base pair region from position 49.815 to 51.249. A total of 113 nucleotides in CHG context are present in this region. For K1036, the average methylation level was 0.73 whereas for DH00/086 the average methylation level was 0.03. A student T-test performed in Microsoft Excel v15.13.1 (150807) assuming unequal variance with a zero hypothesis of no difference between the average methylation level between K1036 and DH00/086 is rejected based on P(T<=t)=9.03E-61. The difference in CHG methylation between K1036 an DH00/086 for scaffold_905 Genome Version 2.0 between bases 49.815 to 51.249 (corresponding to positions 309757-308323 in Scaffold_905 of FIG. 13) was highly significant. The result of the analysis is shown in FIG. 15.

As the bi-sulfite data revealed a markedly high CHG methylation in the K1036 GDS allele, it was decided to obtain bi-sulfite sequencing data from four 861BC1 siblings. All of these four siblings had the GDS allele from grandparent K1036. However, two were highly hermaphrodite (n>100 berries) whereas two other siblings were virtually incapable of producing berries. The hypothesis was that, if methylation plays a role in repressing the female suppressor gene, it would be expected that plants which have the GDS allele of hermaphrodite grandparent K1036 and remain highly methylated would be hermaphrodite whereas plants that for some reason have (partly) lost this methylation would be 'de-repressed' thus have an activated female suppressor and become less hermaphrodite, if not strictly male. The plants that were hypothesized to change their phenotype from highly hermaphrodite into poorly hermaphrodite or even male because of their loss of methylation were designated 'revertants'

Sanger reads from bi-sulfite treated genomic DNA were obtained by PCR using primers that allowed amplification of the bi-sulfite treated template. Towards this end, the GDS gene sequence was imported in Bisulfite Primer Seeker 12S; to make an in silico conversion of the sequence. Subsequently, this sequence was imported in Primer3 (Untergrasser, 2012) to design and select primers. The visual representation in J-Browse of the Watson and Crick sequence reads of bi-sulfite treated DH00/086 and K1036 template allowed for a careful selection of a relatively small target (100.300nt) that included differential methylation (or single methylation polymorphism; SMP's). Primers were selected in such a way that these did not anneal to SMP's as this would create mismatching in differentially methylated DNA targets.

The primers designed were CS77 and CS78 (see Table 33) that allowed for amplification of a 256nt fragment using bi-sulfite treated template DNA. PCR was performed using Kapa Uracil Plus as polymerase (purchased from Sopachem, Ochten, The Netherlands) according to the manufacturers protocol applied on bi-sulfite treated CTAB isolated DNA (Doyle and Doyle, 1990) using the EZ DNA Methylation-Lightning Th Kit (Zymogen Irvine, Calif. 92614, U.S.A). PCR fragments were Sanger sequenced by BaseClear, Leiden, The Netherlands. Sequence alignment in Geneious (Biomatters, Auckland, New Zealand) provided a 'high quality sequence part', which was:

(SEQ ID NO: 113)
TTTGGATGAAGAATGATGATGAGTTCCTAAAAATCATGATTTACGATGGG

GCTTTCATGATTGAAATCATGATAGCGACCGTTGAACCATATGAGCGCAC

ACCTTCTAGCTATCATGCCAAGGACCCAATATTCAAGAAGCCATACTTGG

TCGAAGATCTTCGTGTAGATATGCTCAGGTTGGATAATCAAATTCCAATG

AAGGTCCTGGAGATATTGTCTAAATTCTGCAAGAACAAGGTAAGGAATGT

TAATGAAA

In this high quality sequence part, SMPs that stand out as 'double peak DT SNPs' were found at eleven positions, respectively: 79, 88, 103, 119, 127, 142, 176, 196, 207, 220, and 227 whereas at many other positions (n=26) the bisulfite C to T conversion has been complete thus showing no double peaks but only thymines for the four samples, which was indicative of successful bi-sulfite treatment for all samples analyzed.

To quantify the relative amount of cytosines as their relative peak plot height within the mixed C vs T peak plots of those SMPs, the program Mutation Surveyor 5.0 (Soft-genetics, State College, Pasadena, U.S.A.) was used. The abi files were imported as 'Sample Files' and the high quality sequence FASTA file was imported as the required 'Genbank sequence file' in the Open File menu of Mutation Surveyor. Settings were adjusted in the Process→Settings→Others menu in which the Methylation option was checked. In the Set by User menu, only the CG>TG option was unchecked, followed by pressing 'Run' in the Process dropdown menu and pressing the Mutation Quantifier button in the toolbar. The quantified mutations (SMPs) then appeared in a spread sheet from which the percentage of cytosines in the particular SMPs were taken and summarized in Table 34.

Clearly, the double C versus T peaks revealed single methylation polymorphism or 'SMPs' in which the peak height of the cytosines was higher in the two hermaphrodite samples compared to cytosine peak height observed for the revertants. This means that the methylation was more prominent in the two samples that were highly hermaphrodite, compared to the 'revertants', which was a quantitative rather than an 'all or nothing' difference.

Because bi-sulfite sequencing is technically difficult as it breaks down the target DNA, other methods were applied to quantify differential methylation in the GDS gene.

Towards this end, the sequence was inspected for SMPs that overlapped with recognition sites of methylation sensitive/impaired restriction enzymes.

By this procedure two assays were designed. In a first assay a fragment is amplified using the primers CN67 and CP32 (Table 3 EXAMPLE 1) to cover a 353nt genomic region that includes two recognition sites of the methylation sensitive restriction enzyme EcoRII (CCWGG: targeting CmCTGG on the plus strand and CmCAGG on the minus strand, where mC is the target SMP) at positons 82.86 and 148-152 relative to the CN67 5' prime end. In a second assay a fragment was amplified using the primers CP35 and CN82 (Table 3, EXAMPLE 1) to cover a genomic region that includes a single recognition site for the enzyme GsuI (targeting CTCmCAG and mCTGGAG on the plus and minus strand, respectively, where mC is the target SMP) at position 184-189 relative to the CP35 5' prime-end.

Forty nano-grams of genomic template DNA, isolated using Sbeadex® mini plant kit (LGC Genomics GmbH, Berlin, Germany) on a KingFisher 96 instrument (Thermo-Scientific, Breda, The Netherlands), was subjected to a four hour digestion individually using 2 units of EcoRII and GsuI (Life-Technologies) in 1× standard buffer in a 15 µl volume. Control DNA comprised a similar incubation apart from that the enzyme was replaced by MQ water. Subsequently, 2 µl of this enzyme and non-enzyme treated template DNA was individually used in a 10 µl PCR on a C1000 Touch Thermal cycler covered by a CFX96 Real Time System (Bio-Rad, Veenendaal, The Netherlands) programmed for 98° C. 1 min, 40 cycles of [98° C.: 10 sec, 62° C.: 5 sec and 72° C.: 10 sec] using PhireII (Life technologies) and LC green Biofire defense, Salt Lake City, U.S.A)

TABLE 34

The percentage of cytosines (C + T = 100%) at eleven SMPs in Sanger sequences reads from a 258 nt PCR fragment obtained from bisulphite treated genomic DNA template. Templates are 303 and 580 obtained from two strong hermaphrodites (producing over 100 berries per plant) and 600 and 606 obtained from two 'revertants' of which one produced only a single berry and one does not produce berries at all, despite of their K1036 grand-parental DUF247 allele. For the forward reads some SMPs could not be called because lack of (reliable) information; shown as 'nd'. At 26 other positions the C to T conversion was complete for all samples (results not shown). Note that the percentage cytosines retained in both reads, which is indicative of methylation, is much higher for the hermaphrodites compared to the revertants. This suggests that the apparent loss of methylation reactivates the female suppressor gene which results in lower fruit set of the revertants.

| | | | SMP number (1-11) and their fragment position | | | | | | | | | | |
|---|---|---|---|---|---|---|---|---|---|---|---|---|---|
| | | | 1 | 2 | 3 | 4 | 5 | 6 | 7 | 8 | 9 | 10 | 11 |
| | read | Plant ID | 79 | 88 | 103 | 119 | 127 | 142 | 176 | 196 | 207 | 220 | 227 |
| herma | fw1_1 | 303 | 56.10% | 34.78% | 16.37% | 48.66% | 41.02% | 33.81% | 91.71% | nd | nd | nd | nd |
| herma | fw1_2 | 303 | 59.72% | 47.69% | 19.58% | 46.75% | 39.81% | 36.86% | 94.06% | nd | nd | nd | nd |
| herma | fw | 580 | 69.03% | 43.99% | 20.36% | 56.15% | 43.26% | 37.89% | 94.30% | nd | nd | nd | nd |
| revertant | fw | 600 | 24.34% | 16.38% | 6.97% | 20.31% | 22.32% | 10.52% | 35.80% | nd | nd | nd | nd |
| revertant | fw | 606 | 34.12% | 17.83% | 6.58% | 28.08% | 21.65% | 13.19% | nd | nd | nd | nd | nd |
| herma | rev | 303 | 50.22% | 22.32% | 18.86% | 45.45% | 34.18% | 22.73% | 80.73% | 20.02% | 48.68% | 12.13% | 96.08% |
| herma | rev | 580 | 73.96% | 36.65% | 26.51% | 58.04% | 42.66% | 35.43% | 90.47% | 29.37% | 95.74% | 21.02% | 96.20% |
| revertant | rev | 600 | 19.72% | 6.27% | 0.00% | 10.87% | 12.78% | 5.35% | 23.78% | 5.19% | 19.68% | 0.00% | 85.89% |
| revertant | rev | 606 | 32.69% | 8.92% | 0.00% | 18.97% | 19.31% | 9.05% | 75.91% | 8.41% | 69.42% | 0.00% | 64.70% |

The percentage of cytosines (C + T = 100%) at eleven SMPs in Sanger sequences reads from a 258 nt PCR fragment obtained from bisulphite treated genomic DNA template. Templates are 303 and 580 obtained from two strong hermaphrodites (producing over 100 berries per plant) and 600 and 606 obtained from two 'revertants' of which one produced only a single berry and one does not produce berries at all, despite of their K1036 grand-parental DUF247 allele. For the forward reads some SMPs could not be called because lack of (reliable) information; shown as 'nd'. At 26 other positions the C to T conversion was complete for all samples (results not shown). Note that the percentage cytosines retained in both reads, which is indicative of methylation, is much higher for the hermaphrodites compared to the revertants. This suggests that the apperant loss of methylation reactivates the female suppressor gene which results in lower fruitset of the revertants.

TABLE 35

The CQ values are provided for several backcross individuals typed for gender; segregating for hermaphroditism (andromonoecy) and male phenotypes. Note that in the 861BC1d population individuals (lower Table part), the CQ value is low for plants that have received the grandparental allele from K1036 and that these plants are hermaphrodite, where for plants that received a DH02/504 allele an opposite relationship has been found; high CQ values and a male phenotype.. For plants from other populations 861BC1, a, b, c, e, (top of the Table 35) the CQ values can be much lower for plants having a K1036 alelle, notably those which were found to be male rather than hermaphrodite, these are typed as revertants

| Gender | Population | ID | DUF247 allele origin | Gsul replicate 1 delta CQ | Gsul replicate 2 delta CQ | EcoRII replicate 1 delta CQ | EcoRII replicate 2 delta CQ |
|---|---|---|---|---|---|---|---|
| revertant | 861BC1a | 408877 | K1036 | 5.9 | 5.77 | 2.6 | 1.61 |
| revertant | 861BC1b | 409019 | K1036 | 7.1 | 5.15 | 3.7 | 1.9 |
| revertant | 861BC1b | 409022 | K1036 | 4.5 | 2.97 | 4.7 | 2.37 |
| revertant | 861BC1c | 409274 | K1036 | 3.8 | 3.08 | 3.2 | 2.71 |
| hermaphrodite | 861BC1b | 409151 | K1036 | −0.2 | 0.33 | 0 | 0.23 |
| hermaphrodite | 861BC1e | 409455 | K1036 | 0.9 | −0.66 | 1.2 | −0.11 |
| hermaphrodite | 861BC1e | 409449 | K1036 | 0.3 | 0.08 | −0.4 | 0.01 |
| hermaphrodite | 861BC1e | 409453 | K1036 | −0.1 | 0.02 | 0.4 | 0.48 |
| Gender | Population | ID | DUF247 allele origin | Gsul replicate 1 DNA of November 2012 | Gsul replicate 2 DNA of April 2013 | | |
| male | 861BC1d | 377131 | DH02/504 | 1.32 | 2.28 | — | — |
| male | 861BC1d | 377139 | DH02/504 | 1.60 | 2.70 | — | — |
| male | 861BC1d | 377183 | DH02/504 | 1.28 | — | — | — |
| male | 861BC1d | 377184 | DH02/504 | 3.23 | 2.08 | — | — |
| male | 861BC1d | 377104 | DH02/504 | 2.65 | 3.91 | — | — |
| male | 861BC1d | 377097 | DH02/504 | 2.85 | 1.02 | — | — |
| male | 861BC1d | 377119 | DH02/504 | 1.08 | 2.74 | — | — |
| male | 861BC1d | 377109 | DH02/504 | 3.45 | 1.91 | — | — |
| male | 861BC1d | 377127 | DH02/504 | 4.76 | 4.39 | — | — |
| male | 861BC1d | 377163 | DH02/504 | 2.68 | 4.89 | — | — |
| male | 861BC1d | 377185 | DH02/504 | 2.19 | 5.01 | — | — |
| hermaphrodite | 861BC1d | 377182 | K1036 | −0.49 | −0.02 | — | — |
| hermaphrodite | 861BC1d | 377162 | K1036 | −0.18 | −0.38 | — | — |
| hermaphrodite | 861BC1d | 377134 | K1036 | 0.27 | −0.32 | — | — |
| hermaphrodite | 861BC1d | 377180 | K1036 | 0.23 | −0.04 | — | — |
| hermaphrodite | 861BC1d | 377110 | K1036 | −0.10 | −0.04 | — | — |
| hermaphrodite | 861BC1d | 377142 | K1036 | −0.06 | 0.57 | — | — |
| hermaphrodite | 861BC1d | 377122 | K1036 | 0.01 | 0.22 | — | — |
| hermaphrodite | 861BC1d | 377124 | K1036 | 0.72 | 0.43 | — | — |
| hermaphrodite | 861BC1d | 377152 | K1036 | −0.68 | 0.58 | — | — |
| hermaphrodite | 861BC1d | 377096 | K1036 | −0.34 | — | — | — |
| hermaphrodite | 861BC1d | 377102 | K1036 | −0.54 | — | — | — |

CQ values were determined by a cut off threshold value of 500 CFU.

The CQ value difference (delta CQ), which is the CQ value obtained from digested template DNA minus the CQ value of non-digested template DNA, was used as a measure of DNA methylation.

The result of this pilot is shown in Table 35. Results show that hermaphrodite plants had a delta CQ value of about zero, indicative of high methylation (as the enzyme is not able to cut the template offered for PCR), whereas the revertants had a delta CQ value that is larger than zero ranging 1.9-7.1, indicative for poor methylation in the GDS gene region, targeted by this method. For population 861BC1d it showed that male plants which have the DH02/504 grand parental GDS allele have delta CQ values larger than zero, whereas the hermaphrodites which have the K1036 grand parental GDS allele had delta CQ values approaching zero.

This shows that this method can be used to monitor a male plant for its hermaphrodite tendency, thus its capability to produce berries. The skilled person will recognize that the method of methylation sensitive restriction enzyme digestion, followed by Q-PCR is a rough method and not perfect. For instance results presented in Table 35 reveal that one hermaphrodite (ID: 409455) showed a delta CQ of 1.2 (rather than about zero) for EcoRII replicate 1. The skilled person will understand that to use this method optimally, several replications and the use of more targets, preferably using several methylation sensitive restriction enzymes is preferred. In conclusion, similar to what has been observed in the bi-sulfite sequencing experiment, in the Q-PCR experiment differential DNA methylation has been detected as inferred from the difference in CQ of methylation impaired restriction enzyme treated template DNA relative to the non-treated template DNA used for PCR. For the revertants and also for the males, the low methylation stood out as a high relative difference in the CQ values obtained from methylation impaired restriction enzyme treated template DNA relative to the non-treated template DNA used for PCR. This differential methylation clearly and stably segregated in backcross population 861Bc1d. The methylation of the GDS grandparental allele of K1036 was shown to be unstable in other pedigrees consistent with the hermaphrodite phenotype, which was also unstable. Micro-satellite marker analysis, using more than five hyper-variable loci, has demonstrated that those unstable plants or revertants were plants that truly belonged to those pedigrees (results not shown).

There is an increasing number of scientific papers that report on the methylation of genes and genomes and the inheritance of epi-alleles (e.g. Ji et al., 2015; Greaves et al., 2014, Zhang et al., 2013). In plants DNA methylation is separated in three distinct contexts; CG, CHG, and CHH (where H=A, T or C). Regions of the genome methylated in all three contexts often lead to silencing in the targeted region and in some cases neighboring regions (see reference in Ji et al., 2015). Many of the silenced genes have a lower expression because of promoter methylation spreading from repeat sequences (or duplications) into genes (cmWIP1, booster1, BSN, FOLT1; see Ji et al 2015). There are some examples in which methylation of exons, rather than in the promoter, results into a lower expression. One of the earliest examples is found in the so called clark kent (clk) alleles of the SUPERMAN gene in *Arabidopsis*. Superman is a gene which results into a higher number of anthers when knocked-out out by gene mutations for which allelic forms were found that provide the same phenotype but revealed no nucleic acid differences from the wild type. Bisulfite sequencing however revealed for those (elk) phenotypes that there was no cytosine methylation in wild type or in a sup 'nonsense' allele (sup-1) whereas extensive methylation in all contexts was found in the elk alleles covering the start of transcription and most of the transcribed region. Interestingly, also revertants and stronger and weaker elk alleles were observed that were related to DNA methylation. The phenotype reversion is correlated with both the restoration with the wild type RNA expression and a decrease of cytosine methylation of the SUPERMAN gene DNA.

The skilled person will understand that the methylation observed for the asparagus GDS locus, and the phenomenon of revertants related to reduced methylation as was demonstrated in the present document, mirrors the situation found for SUPERMAN. For technical reasons combined with the low wild type expression of the GDS gene it appeared impossible to unequivocally determine whether the GDS gene methylation results into a lower expression or alternative sequencing. The skilled person will understand such a relationship is very likely and that gene capturing techniques followed by RNAseq studies, sampling specific tissues or developmental stages will likely confirm the relationship between the hermaphrodite phenotype and the methylation of the GDS gene and the lowered expression levels or splicing.

This present example reports on epigenetic control of hermaphroditism in lot K1036 and its derived progenies. It discloses that methylation of the GDS gene provides a method to obtain a hermaphrodite plant. The present example also demonstrates that methods that allow the detection of methylation, such as but not limited to bisulfite sequencing (parts of) the GDS gene or the use of restriction enzymes impaired by methylation that target the GDS gene, can be used in diagnostics to predict whether a plant has a tendency to become or to stay hermaphrodite.

The skilled person will recognize that there are many methods that allow for the detection of DNA methylation such as, but not limited to methods reviewed by Shen & Waterland, 2007 and that any such method can be used in the present invention.

The skilled person will also recognize that influencing DNA methylation of the GDS either by increasing or reducing it, will result in changes in either gene expression and/or splicing that will reduce or increase female suppression. Methylation in the present example is confined to the transcribed region but the skilled person will also understand that methylation of the promotor or other cis acting elements near the gene may result into reduced expression or alternative splicing and thus may result into reduced female suppression. Methylation in all context could he established by virus induced gene silencing and a part of this methylation may persist even after the virus has been eliminated (e.g. see Dalakouras et al., 2012).

Other methods to establish gene methylation are proposed by Zhang & Hsieh (2013) who state that crop improvement via locus specific epigenetic manipulation has become increasingly feasible with TALE or CRISPR-based genome editing techniques.

Recently, targeted methylation has been achieved to reduce the expression of a gene that is expressed in many forms of human cancers (Nunna et al., 2014), by targeted methylation of the gene its promoter. These authors used an engineered Zinc Finger that specifically binds to a gene promoter that has been fused to the catalytic domain of a DNA methyl transferase. The skilled person will understand that any technique that provides a catalytic moiety which delivers a silencing signal together with a targeting part, which ensures the specific binding of the catalytic moiety to a defined genomic target may allow targeted methylation. Such techniques may be developed in near future. Rather than Dnmt3a methyl transferase as has been used by Nunna et al., a methyltransferase is preferred that enhances the CHG methylation of the coding region of the DUF247 gene. A similar hypermethylation effect may be achieved by targeted histon modification. Examples of genes involved in non-CG methylation are reviewed in Stroud et al (2014). The present example teaches that methylation in all contexts but notably CHG methylation of the exons and intron of the DUF247 gene will results in feminization.

Example 4

A Histidine to Glutamine Mutation in the Second Predicted Exon of the GDS Gene

Cultivar K5756 is an all-male hybrid cultivar which is a cross between a clonal female plant; 169F1-85V and a doubled haploid male plant; DH05/128. The latter doubled haploid was selected as parental plant because it, among other criteria, was not capable of producing berries First year plants of this hybrid were first raised at a nursery farm after which the crowns were replanted in a hybrid evaluation field.

There was a small chance that a crown could be divided in two crowns when crown were bagged prior to transplanting.

Hybrid K5756 was trialed in four replicate plots of twenty plants each.

When evaluated, two different plants in the same plot were full of berries whereas all other individuals of this hybrid in any of the four plots bore no berries at all and those berries comprised viable seeds At the moment of inspection late in the season some blown flowers were still present on the two plants bearing berries which showed the remnants of anthers and large petals which confirmed their apparent pistillate and staminate, thus truly hermaphrodite nature. Berries harvested from the two plants provided 1016 seeds in total. Fern was taken from the two hermaphrodites and a control plant of the same hybrid. Template DNA obtained from the two hermaphrodites was Sanger sequenced in both forward and reverse direction using primers combinations CN82/CN67, CN59/CN70, CN69/CN81. Sequence reads obtained from both primer pairs CN59/CN70, CN69/CN81 disclosed a similar cytosine to arginine transversion. This transversion disrupts the second of in total three HphI restriction sites (in this case 5-^(N)7TCACC-3) present in the CN69/CN70 PCR fragment, and thus that fragment could be used in diagnostics. This type of diagnostics was performed on the two hermaphrodites and a male control sample taken from the field. This analysis, commonly referred to as CAPS marker analysis, confirmed that the particular transversion was unique for the two hermaphrodite plants. Microsatellite analysis using seven proprietary hypervariable loci showed that the two hermaphrodites had an identical genotype which differed from the control sample.

However, both the alleles observed in the hermaphrodite and the male plants confirmed that these belonged to the same hybrid. In conclusion, a mutation was found in the M-linked GDS gene in two hermaphrodite clonal copies in all male hybrid 5756. This clone provided the only hermaphrodite specimens found in this hybrid. The particular mutation changes the cytosine (at position 684 of SEQ ID NO:1) at the third codon position of a histidine (H) into a adenine, providing a codon for a glutamine (Q); thus CAC>CAA.

Example 5

A Mutation Changing a Proline to Threonine in the Second Predicted Exon of the GDS Domain Containing Female Suppressor Gene Creates an Hermaphrodite Cultivar K4381 is an all-male hybrid cultivar which is a cross between female doubled haploid DH366/1 and male doubled haploid DH02/047, each of which were obtained by anther culture. D1102/047 was selected among other criteria, as parental plant of this hybrid because it produced no berries. For over 190 genetically different hybrids made by DH02/047 tested there were no reports of fruit set in our breeding database Individuals of such doubled haploid× doubled haploid hybrids as K4381, are genetically identical.

The cultivar K4381 was grown in a 4 times 20 plants (thus n=80 plants)field trial. Among these eighty plants, a single plant was identified that was fully hermaphrodite. This single plant produced hundreds of berries, comprising viable seeds whereas all other individuals produced no berries at al. This hermaphrodite off-type plant was analyzed for microsatellite markers which showed that it was fully identical to a reference individual of this particular K4381 cultivar (results not shown). In conclusion, this hermaphrodite individual was not the result of a genetic impurity within this trial. To find out whether a mutation in the GDS gene generated the K4381 hermaphrodite plant, sequences were obtained for this K4381 hermaphrodite plant using the primer pairs CN82/CN67, CN59/CN70, CN69/CN81. These primers span the first predicted exon, the predicted intron 1 and the second predicted exon of the GDS gene.

Compared to the reference genome, a polymorphism was found that was already previously identified. This polymorphism comprises a stretch of seven thymine's rather than six, close to the predicted intron 1 acceptor site found at scaffold 905 (genome version 2.0) position 50,941-50,946, which is also found in similar haplotypes such as in super-male 12_25, hermaphrodite 5375, all male hybrid K323 and hermaphrodite mutant K323-G033. More importantly, a single nucleotide polymorphism (SNP) was found for which hermaphrodite individual K4381 is unique compared all haplotypes known and sequenced so far. This SNP is a cytosine to an adenine change in the first predicted exon, corresponding to position 166 of SEQ ID NO:1. which leads to a proline into a threonine amino-acid change at position 56 of SEQ ID NO:2

This particular mutation is a non-conservative substitution as a non-polar amino-acid is changed for a polar amino-acid. The present example teaches that this particular amino-acid change in the GDS gene apparently is sufficient to change a male into an hermaphrodite plant which produces much more berries than its male ancestor.

Example 6

An Asparagus Homologs of Defective in Tapetal Development and Function 1 is the Male Activator Gene To isolate the male promoter gene, the M-locus region was further investigated by applying BioNano Genome Mapping (Bionano Genomics). By this approach, DNA sequence genome scaffold (including scaffolds tagged by sex linked markers) were aligned to BioNano contigs, and one contig, likely spanned the M-locus. New genome sequencing scaffolds were identified and on one of those scaffolds in a part of the genome where female reads do not map to the male reference genome, a candidate gene homologous to As-TDF1 was identified.

The hemizygous presence of TDF1 in males; the phenotype of its deletion mutants and a study of expression and genomic read mapping in of *Asparagus* genes homologous to member genes, expected to act in the pathway downstream AS-TDF indicate that AS-TDF1 is the male stimulator gene.

High Molecular Weight genomic DNA of the *Asparagus officinalis* genotypes DH00/086 and DH00/094 was isolated. DH00/086 is the supermale used by the Leebens-Mack laboratory University of Georgia at Athens to create a reference genome of asparagus. DH00/094 is a female doubled haploid obtained by tissue culture from the same hybrid from which the double hybrid male DH00/86 originates (Limgroup BV, Horst, The Netherlands) For this, fresh leaves were washed in 10 mL of TEN buffer (10 mM Tris, 10 mM EDTA, 100 mM NaCl, pH7.5) and fixed in freshly prepared TEN/2% formaldehyde solution. The leaves were chopped in very small pieces and incubated in 15 mL Isolation Buffer (IB: 15 mM Tris, 10 mM EDTA, 130 mM KCl, 20 mM NaCl, 8% (m/V) PVP10, pH19.4) containing+ 0.1% Triton X-100 to release the nuclei. The nuclei were purified by density gradient centrifugation on 20 mL of 75% Percoll in IB/0.1% Triton X-100 for 20 min at 2000 RPM. The resulting stabilized homogenate was embedded in an agarose matrix by gentle mixing with IB/1.5% Low Melting Point agarose at 60° C. followed by poring the mixture in a precooled agarose plug mold cast (Bio-Rad, Hercules Calif., USA)) on ice for 10 min. The 220 µl, plugs were collected in lysis buffer (1% sarkosyl, 0.25 M EDTA pH 8.0 and 0.2 mg/ml proteinase K) at 50° C. for one day with one change of lysis buffer. After extensive washing in TE buffer the HMW DNA was recovered by gentle melting at 60° C. and GELase™ (Epicentre, Madison, Wis., USA) treatment using 3 units of Gelase™ per plug for 10-20 min. The High Molecular Weight (HMW) DNA was further cleaned by drop dialysis prior to quantitation on CHEF electrophoresis (CHEF-DRII system, Bio-Rad, Hercules, Calif., USA). On average, 3-4 µg HMW DNA was obtained per plug.

The HMW DNA was processed in-house at BioNano Genomics Laboratories (BioNano Genomics, Inc., San Diego, Calif., USA) creating Genome Maps i.e. long range Physical Maps (reviewed by Brown, 2002) of the *Asparagus* male and female genomes using their proprietary Irys Technology pipeline. The Irys Technology involves labelling HMW DNA with fluorescent dyes (IrysPrep®), movement of single molecules in nanochannels (IrysChip®), scanning of the molecular position of the dyes by a CCD camera (Irys Instrument) and de novo assembly and visualization of Genome Map contigs (Irysview Software®, Shelton et al., 2015).

Briefly, 8 μg of HMW DNA was labelled according to protocols in the IrysPrep® method. The HMW DNA was nicked with the nicking endonuclease Nt.BspQI at GCTCTTCN/N positions (New England Biolabs, NEB, Ipswich, Mass., USA). Nicked DNA was labelled with Alexa546-(Thermo Fisher Scientific, Waltham, Mass., USA) and Taq polymerase (NEB). After labelling, the DNA was ligated by adding dNTPs and T4 DNA ligase (NEB). The labelled DNA samples were pipetted onto individual IrysChip® in both flow cells. The Irys Instrument controls the movement of DNA in the flow cells electrophoretic ally. Linearized molecules were imaged using green lasers for Alexa546. A CCD camera, coupled with proprietary auto-focusing mechanism and control software, rapidly scanned the chips. Next, the locations of labels (Alexa546) along each molecule individually were detected and analysed using the Irysview Software® package. Raw image data of labelled long DNA molecules are converted to digital representations of the motif-specific label pattern. First, the raw image data of labelled long DNA molecules were converted to digital representations of the motif-specific label pattern. Next, single-molecule Nt.BspQI data were clustered by scoring all molecule maps for similarity to one another and clustering by the R-package Fastcluster (Daniel Müllner, 2013). From the clusters, the label locations were plotted. Finally, the data were assembled de novo using IrysView® data analysis software to recreate a whole genome consensus map of the original genomes of *Asparagus officinalis* genotypes DH00/086 and DH00/094. For *Asparagus officinalis* genotype DH00/086 (Male) 88Gb (79X) of data was collected (molecules>150 kb). The resulting BioNaono Genomics consensus assembly size was 1.205Gb contained in 1364 contigs. The contig assembly of the data exhibited a contig N50 of 1.24 Mb. The contig database is referred to as BNG V1.0 and individual contigs as prefix <BNG>number.

Figure 16:
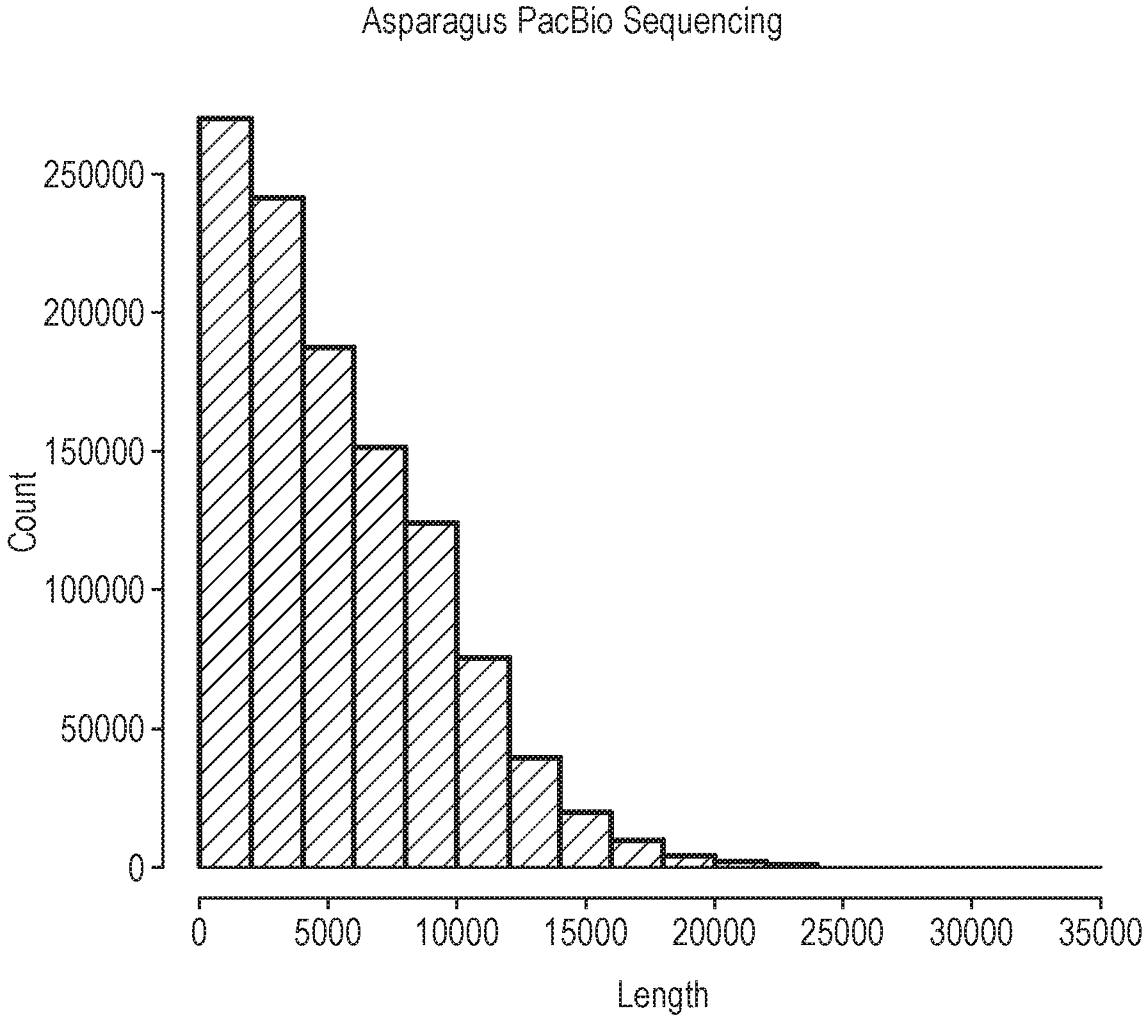

The scaffolds Reference genome of *Asparagus* obtained by NGS (AGS V1.10) were linked to the BNG V1.0 contigs using the Irysview Software® package. First the AGS V1.10 was upgraded by aligning long sequencing reads obtained by PacBio RS II sequencing (Pacific Biosciences, CA, USA) to the AGS V1.10 scaffolds using an algorithm and associated software tool named BPJelly (English et al., 2012). PBJelly is a highly automated pipeline that aligns long sequencing reads in fasta format to draft assembles. PBJelly fills or reduces captured gaps (N-stretches in AGS V1.10) to produce upgraded draft genomes. Briefly, High Molecular Weight (HMW) genomic DNA of the *Asparagus officinalis* genotypes DH00/086 and DH00/094 was isolated as described before and used as input for PacBio SMRTbell library preparation according to the manufacturer instructions (Pacific Biosciences, CA, USA). The prepared library was size selected for >20Kb fragments using the BluePippin System for targeted size-selection of HMW DNA (Sage Science, MA, USA). The collected fraction was sequenced within 2 SMARTcells on a PacBio RS II sequencer at the University of Florida Interdisciplinary Center for Biotechnology Research (ICBR, USA). Nearly 6.07Gb of long read sequencing data were generated corresponding to 4.6× coverage of the *Asparagus officinalis* genome. FIG. 16 displays the observed length distribution of the PacBio experiment. PBJelly was run at Beijing Genomics Institute (BGI, Shenzhen, China). The resulting Reference Genome is referred to as *Asparagus* Genome Scaffold V2.0 (AGS V2.0) and individual scaffolds as prefix <AsOf_V2.0_scaffold>number. The annotation metadata were stored as individual files in AGS V2.0 based relational databases.

The AGS V2.0 scaffolds larger than 20 Kb (5198 AGS V2.0 scaffolds representing 1,113 Mb) were used in mapping to the BNG V1.0 contigs by detecting the recognition sequences of nicking endonuclease Nt.BspQI at GCTCTTCN/N positions in silico. The resulting physical maps of the AGS V2.0 scaffolds (Query_id) were aligned to the BNG V1.0 physical maps (Anchor_id) using the Irysview Software® package with standard settings of stringency. This software creates Matches (Match_ids) of Anchor_ids and Query_ids. In total, 2725 AGS V2.0 scaffolds (52%) were aligned to the BNG V1.0 contigs representing 875 Mb (79%). The resulting comparison map (cmap) was stored as

*Asparagus*.
V2.0.genome.stable_BspQI_res29_to_20150505_
asparagus_UGA_Assemble_Mol ecules.xmap and could be viewed using the Irysview Software® package by highlighting the data in the Compared Maps mode. Within this environment several aspects of the cmap could be visualized and a table of Matches for each individual Match_id listing corresponding Anchor_id, AnchorStart, AnchorEnd, Anchor size, Query_id, QueryStart, QueryEnd and Orientation of the Query_id with respect to the Anchor was included. Table 61 summarizes the results of the Compared map for *Asparagus officinalis* genotype DH00/086 (Male) V2.0 scaffolds that were detected using genetic marker information, such as the HRM markers from Table 3, and physical information (BAC clones; results not shown) The first column shows the ASG V2.0 scaffolds used for comparison based on genetic marker information in the third column (sex linked) and corresponding BioNano V1.0 contigs. A total of eight corresponding BioNano contigs (BNG7, BNG22, BNG28, BNG55, BNG438, BNG833, BNG1030 and BNG1138) were detected and it was established by inspection of the nicking data of the listed BNG contigs that there were no physical overlaps between these contigs. These data (Table 61) strongly suggest that all eight contigs cluster on the chromosomal region covering the M-locus of *Asparagus officinalis*. All eight contigs were inspected for the sequence content of aligned AGS V2.0 scaffolds and their collinearity between their BNG V1.0 and AGS V2.0 cmaps.

Figure 17:
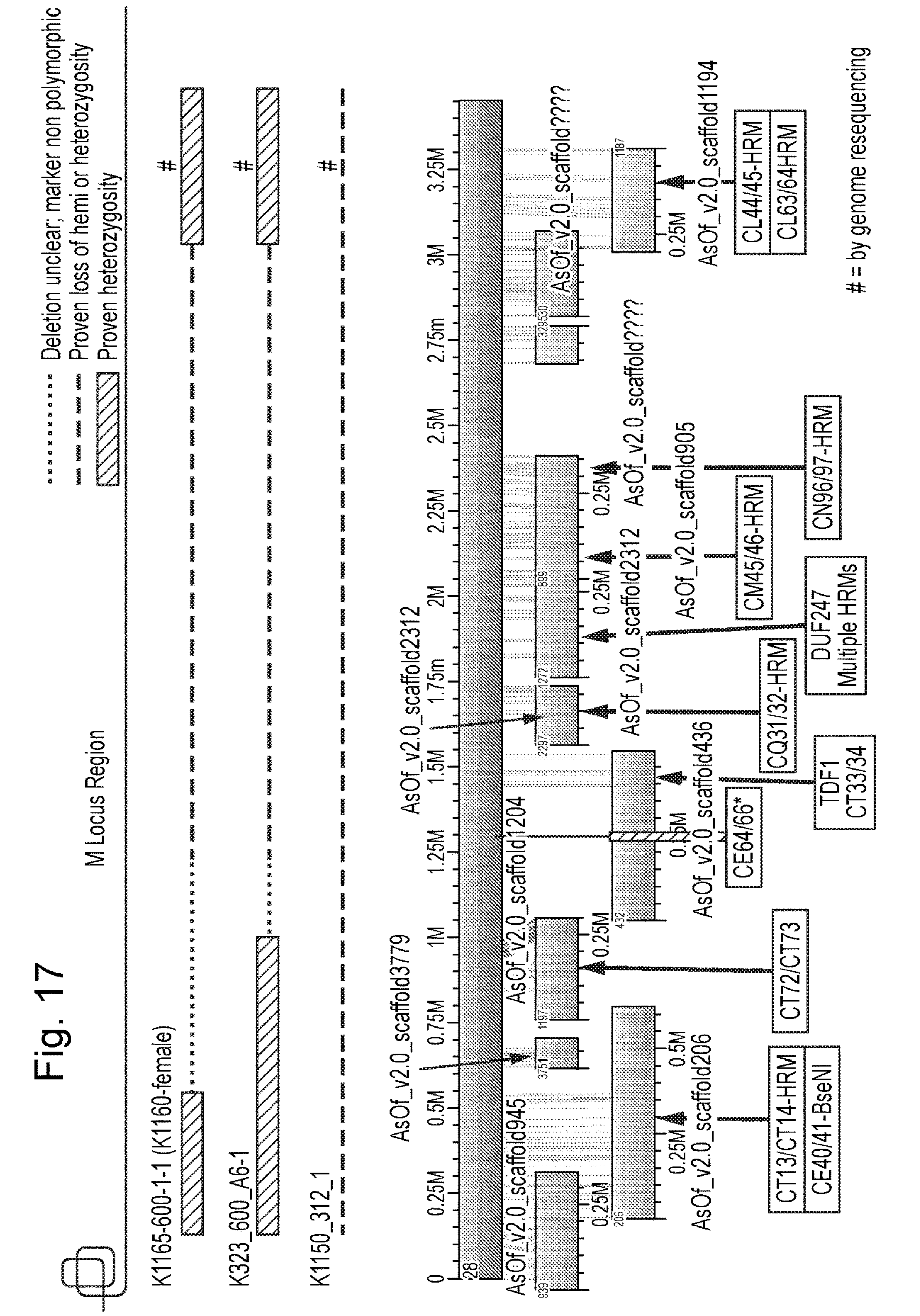

BNG28 is 3.45 Mb in length and the cmap shows linearity for the GDS containing AsOf_V2.0_scaffold905 as well as the sex-linked AsOf_V2.0_scaffold206, AsOf_V2.0_scaffold945, AsOf_V2.0_scaffold1194, AsOf_V2.0_scaffold1204, AsOf_V2.0_scaffold1539 and AsOf_V2.0_scaffold2312 (FIG. 17, Table 3). The sex linkage of these scaffolds has been previously demonstrated using molecular markers in populations segregating for gender (results not shown). Markers that have been used to test the sex linkage of those scaffolds are listed in Table 3In addition, four scaffolds, AsOf_V2.0_scaffold436, AsOf_V2.0_scaffold2510, AsOL_V2.0_scaffold3294 and AsOf_V2.0_scaffold3779 matched BNG28 and were not identified before (labeled 'new' in the third column of Table 61), The cmap of BNG28 and the 11 indicated AGS V2.0 scaffolds revealed the linear order of the scaffolds on BNG28, the orientation of the scaffolds and the chimeric nature of five scaffolds. Chimeric nature is defined as the joining of one or more sequence assemblies in scaffolds of *Asparagus officinalis* V1.10 and V2.0 that are not reflecting the original genomic DNA sequence used in Next Generation Sequencing and Genome Assembly. As a result, AsOf_V2.0_scaffold206, AsOf_V2.0_scaffold436, AsOf_V2.0_scaffold945, AsOf_V2.0_scaffold1204 and AsOf_V2.0_scaffold2312 were found to be chimeric. This was confirmed by the presence (not MSY) or absence (MSY) of female reads of DH00/094 resequencing data in a JBrowse environment (JBrowse 1.1.16, Skinner et al., 2009, MSY refers to the male-specific region of the Y chromosome, which is a term taken from human genetics (but also applied for dioecious plants such as *papaya*; see Yu et al 2009) meant to clarify that the genome segment is male specific, which means that reads obtained from a sequenced female will not show, thus lack, reads mapped to such a region of a male reference genome.

The seven remaining AGS V2.0 scaffolds in table 61 known to be sex-linked that matched to a cmap other than BNG28 were also inspected for their chimeric nature and the positions of the genetic marker sequences within these scaffolds. From the seven scaffolds, AsOL_V2.0_scaffold997 and AsOL_V2.0_scaffold1166 were found to be chimeric. The non-matching sequences of these scaffolds were extracted and used in a new mapping to the BNG V1.0 contigs essentially as described for the AGS V2.0 scaffolds representing 1,113 Mb. As a result, AsOf_V2.0_scaffold997 Region=1 . . . 140,022 that did not match to BNG222 and containing a sex-linked marker (data not shown) mapped to BNG28 at positions 1,093,801 . . . 1,169,913 overlapping with the non-colinear region of AsOf_V2.0_scaffold436. The non-matching sequence of AsOf_V2.0_scaffold1166 aligns to BNG37.

All AGS V2.0 cmap regions that were strictly colinear with BNG28 were either extracted and used for AUGUSTUS Gene Prediction (Hoff et al., 2013) or manually inspected in JBrowse environment. The translated annotations were used as Query in the alignment software BLASTP Program Blast2.3.0 using a database of the non-redundant protein sequences (nr) of Genbank CDS translations plus protein sequences in the databases PDB, Swissprot, PIR and PRF excluding environmental samples from WGS projects (ncbi.nlm.org updated October 2015 version 210). The sequences were limited to the Viridiplantae [ORGN] including a filter for low complexities. All other settings were default. The resulting BLAST scores were filtered (e-values<1E-40) and manually curated for mis-annotations and checked read coverage of female DH00/094e in J-Browse Next to the DUF247 gene model, proven to be involved in female suppression, now designated the GDS gene, two other gene models were found that could be involved in flower developmental fate of maleness, femaleness and hermaphroditism: PREDICTED: LIPID TRANSFER PROTEIN1 (LTP1) Gene Model At2G38540 in *Arabidopsis thaliana* on AsOf_V2.0_scaffold905 and PREDICTED: transcription factor MYB34 [*Phoenix dactylifera*] on the part of AsOf_V2.0_scaffold436 that is colinear with BNG28 Region=380,000 . . . 496,167. The LTP1 gene maps in the linear order of BNG28~280Kb distal to the DUF247 Gene Model, now designated the GDS gene and genetic mapping experiments using informative markers between these two Gene Models show that LTP1 is not fully sex-linked (Limseeds BV, Horst, The Netherlands). The MYB34-related Gene Model is ~600Kb proximal to the DUF247 Gene Model now designated the GDS gene. The MYB34-related Gene model was further investigated since several studies indicate that MYB-class transcription factors are key regulators in pathways involved in developmental processes and general stress responses. MYB33, MYB35, MYB65 and MYB103 are transcription factors acting in gene regulatory networks involved in later stages of stamen development, more precise the stages described as tapetal development in early microsporocyte development (Jun Zhu et al., 2008, Harkess et al., 2015, Ci-Feng Cai et al., 2015). The MYB34-related Gene Model was inspected by Sanger sequencing using several gene-specific primers and one N-stretch could be filled using de novo assembly of the gap using RNA-Seq data. One inverted repeat was discarded from the assembly. The reconstructed MYB34-related Gene Model has three introns (FIG. 18) and codes for a 276 AA Protein of 31 Kdal (FIG. 19). When re-used as Query in BLASTP, using a database of all non-redundant Genbank CDS translations, the SmartBlast option was used. The SmartBlast option in NCBI Blast environment returns a concise summary of the best matches in the sequence database together with the two best matches from well-studied reference species, showing phylogenetic relationships based on multiple sequence alignment, and conserved protein domains. Using SmartBlast in standard settings the output was: protein DEFECTIVE IN MERISTEM DEVELOPMENT AND FUNCTION 1 (thale cress), PREDICTED: myb-related protein 308 (chickpea), PREDICTED: transcription factor MYB35-like (soybean), PREDICTED: transcription factor MYB76 (*Nelumbo nucifera*), PREDICTED: transcription factor MYB34 (date palm). The *Arabidopsis thaliana* DEFECTIVE IN MERISTEM DEVELOPMENT AND FUNCTION 1 gene belongs to the MYB35-subclass of MYB-containing gene family and is characterized by two DNA-binding SANT Superfamily domains (also referred to as R2R3 sub-class). Binding is sequence dependent for repeats which contain the G/C rich motif [C2-3A (CA)1-6]. The domain is strictly found in the Plant Kingdom as part of regulatory transcriptional repressor complexes where it binds DNA (reviewed in Jin and Martin, 1999). The DEFECTIVE IN MERISTEM DEVELOPMENT AND FUNCTION 1 gene of *Arabidopsis thaliana* has been mapped-based cloned by using a single mutant line and a mapping population derived thereof (Jim Zhu. 2008) and was renamed Defective in Tapetal Development and Function 1 (ATH TDF1) describing its essential role in anther development and tapetal function for microspore maturation in *Arabidopsis thaliana*. The *Asparagus officinalis* MYB34-like gene used as Query also belongs to the MYB35-class of transcription factors and shares high sequence identities in the SANT Superfamily domains with ATH TDF1. The MYB34-like Gene Model was therefore renamed AsOf TDF1-like. The SANT Superfamily domain in AsOf TDF1-like is found twice at residues 16(H)-60 (Y) and 76(F)-K (151). Members of MYB35-related proteins are ~300-350 amino acids whereas AsOf TDF1-like has 276 amino acids; the proteins have high identities in the N-terminal SANT Superfamily domain organization and sequence identities are lower towards the C-terminal end of the proteins. When the ATH TDF1 protein sequence is taken as Query in AGS V2.0 database, the tBLASTN output has two significant hits: next to the AsOf_V2.0_scaffold436 also AsOf_V2.0_scaffold1220, the latter having less identity in the highly conserved first SANT Superfamily domain (78% versus 52% see FIG. 20).

In order to find out whether male sterile plants thus lacking a functional TDF1 gene could be obtained renewed irradiation experiments were performed.

Seed lots of three different all-male hybrids, designated K1150, K323, and K1129 all of which originated from crosses between doubled haploids, thus which per seed lot would yield genetically similar individuals, were subjected to a dose of 300 gray (n=11.00 seeds) and 600 gray (n=13,000 seeds) irradiation from a Cobalt 60 source as has been explained in EXAMPLE 2.

The father plants of these hybrids were, among other criteria, selected because these were virtually incapable of producing berries. K1129 has once before sporadically produced a few berries in one year in one of a total of six trails and these plants have not been further investigated, K323 and K1150 never produced berries in multiple trials.

Plants raised from these seeds were grown in seedling trays from which plants were finally transferred into an evaluation field near Trujillo (Peru). The particular hybrids were chosen because these have no tendency to produce berries spontaneously as was established during their previous evaluation, throughout the years. Any berry produced on plants therefore would thus be indicative of a mutation that caused this ability to produce berries. A number of 6,680 plants obtained from 24,000 seeds that survived the irradiation treatment were inspected for fruit set after 10 months of plant growth, where after four months the fern was cut to obtain renewed flowering and/or fruit set that was observed 6-8 weeks later (November-December 2015) three times by our local assistants. The majority of those plants originated from a 300 gray dose as for the 600 gray dose only 1492 plants from 13,000 irradiated seeds survived the treatment. Sixteen plants were found to be capable of producing berries from at least one of their branches. The number of berries formed per plant varied from 1 to 174 berries. However, because plants were heavily infected by the citrus gall midge *Prodiplosis longifila* Gagné which had caused damage on the berries and caused fruit abortion, the number of berries found on a plant could not be interpreted as a quantitative measure of female fertility. In conclusion: the presence of more than one berry was a qualitative indication of female fertility. One of the 16 plants, capable of producing berries (K1150-600-1) had two female flowers. In a second stem flush photographs of both K1150-600-1 and K323-600A6 could be taken but not of the third plant showing the deletion (K1150-300-12) that did not retained its growth after a fern cut, but from which F1 plants are currently growing in our greenhouse for further analysis.

Figure 23A:
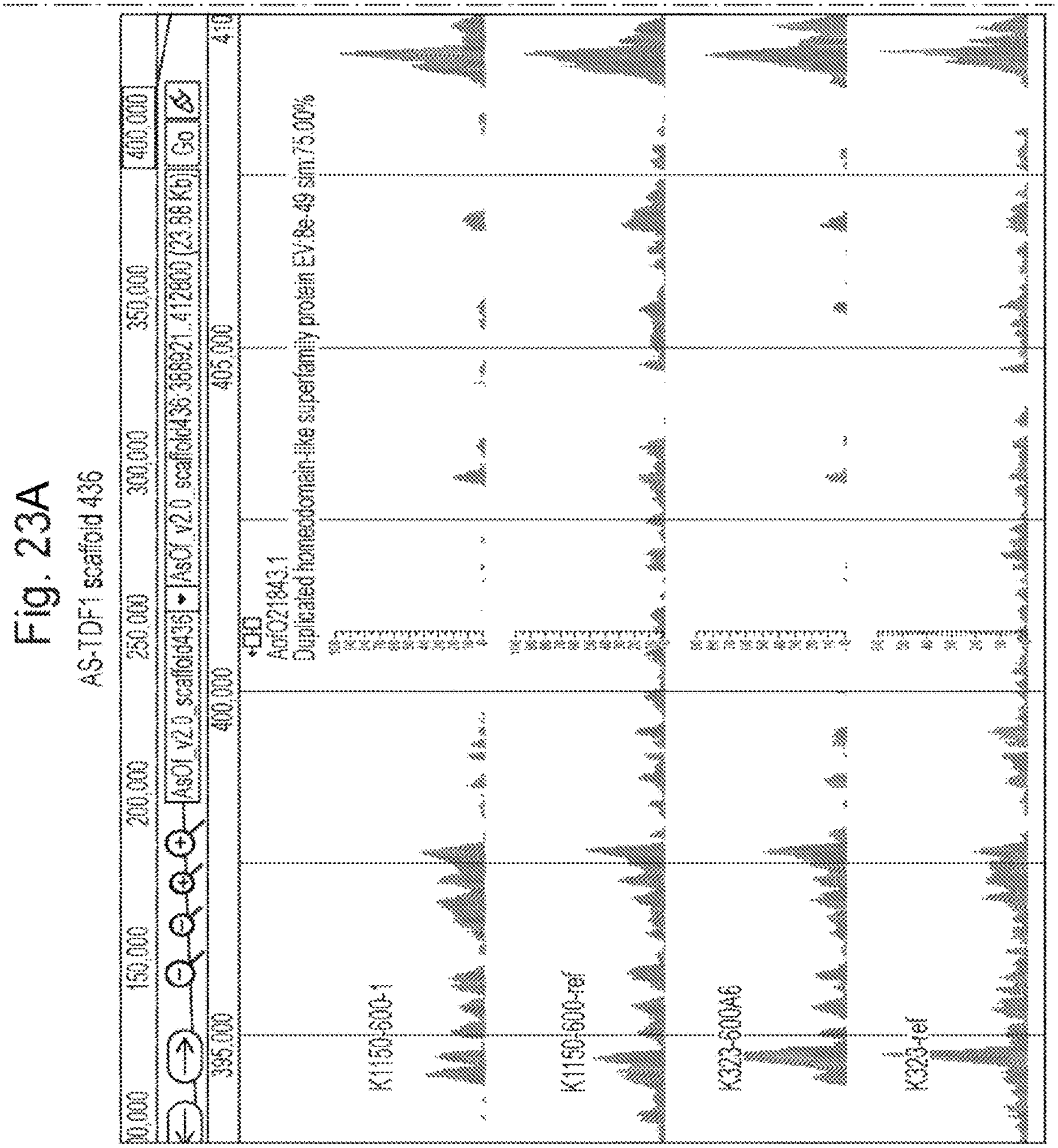
Figure 23B:
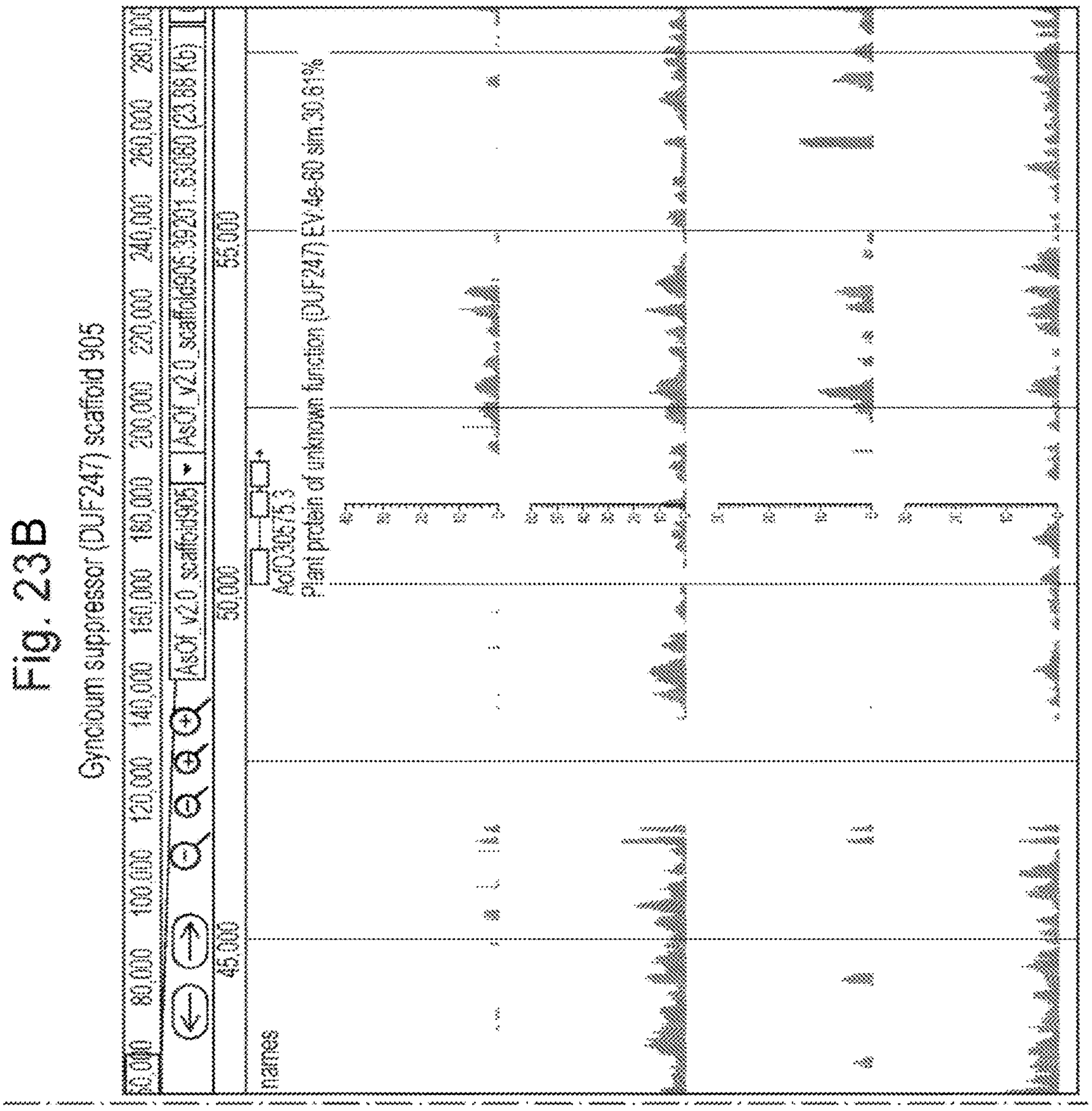

Template DNA of the plants that were capable of berry production and some DNA of non-berry producing male control plants was used in High Resolution Melting Curve analysis (essentially performed using guidelines described in Gady et al., 2009) using primer pairs CP31/CP32, CP33/CP34, CP35/CP36, CP37/CP38, CP39CP40, CP41/CN72 targeting the DUF247 containing M locus linked female suppressor gene or GDS gene. These primers are listed in Table 3. Fragments were analyzed for melting curve differences that would be indicative of a mutation in the M-locus linked Gynoecium Development Suppressor (GDS) gene. It appeared that fragments could not be amplified or give rise to a melting curve shape that looked very different compared to the wildtype melting curves for three of the sixteen plants analyzed. This suggested that template DNA required for amplification of the authentic DUF247 comprising M-locus linked suppressor gene of gynoecium development (GDS) was lacking in those three plants. To confirm this hypothesis genomic DNA has been sequenced using massive parallels sequencing for K1150-600-1, K323-600A6, and K1150.300-11 according to methods disclosed in EXAMPLE 2. Mapping of reads, notably in the hemizygous M locus region, inspected by using J-Browse indicate lack of female reads as in natural female (see FIG. 23). At regions flanking the hemizygous M-locus, loss of heterozygosity is observed where the deletion overlaps with a heterozygous part of the chromosome. The determination of the correct border of the deletions created is pending.

As female plants are also expected to naturally lack the M-locus linked gynoecium development suppressor gene GDS which may occur spontaneously by an extremely small (but unneglectable) chance in the seed lots, plants were analyzed for their genetic purity. Template DNA obtained from those individual plants was subjected to an microsatellite analysis using 14 proprietary microsatellite markers (comparable to the design, use and discriminative power as outlined by Caruso et al., 2008; in fact AO110 is their marker CV291890) and seven proprietary high resolution melting curve SNP markers which showed that 14 of the 16 plants capable of berry set certainly were authentic representatives of the hybrids these belonged to. Two other plants showed a deviating microsatellite genotype. One of those plants showed different alleles at all 14 microsatellite loci and five SNP marker loci and because of this certainly was not an authentic member of the hybrid. Another plant showed all the microsatellite alleles expected for the particular hybrid to which it belonged with one notable exception, which was the lack of the paternal allele for the AO022 microsatellite marker, known to be linked to the M locus region. The typical single loss of the paternal allele of sex linked locus AO022 is expected to be indicative of the loss of a chromosomal segment that must have been lost as a result of the Cobalt 60 irradiation. This segment, at least for that particular plant, must span the region between the rising M-locus linked gynoecium development suppressor (GDS) gene and microsatellite marker locus AO022.

An overview of the microsatellite analysis used to confirm the authenticity of the mutants and their control hybrids is shown in FIG. 21.

All plants that lacked the GDS gene fragments were further subjected to markers targeting genome scaffolds that were known to be positioned genetically close or positioned in the M-locus region)

These primer pairs were:

CK63/64, CM45/46, CN96/97, CM98/99, CQ31/32, CT13/14, CE40/41 and CE64/CE66 (see Table 3). FIG. 17 shows an overview of the scaffolds (or scaffold parts) that could be mapped in the M-locus region. Depending on whether the markers were informative it is indicated which extra part of the chromosomal segment, thus apart from the Gynoecium Development suppressor gene that was already found to be lacking, is further missing in the irradiated plants capable of producing berries.

It appeared that three plants, for which a mutation event enabled them to produce berries, lack a chromosome segment on which both the GDS gene development and the defective in tapetum development and function gene (TDF1) are located. As pointed out before: of two of these three plants the flowers were inspected and were proven to be of the female type thus which have flowers that have a fully developed gynoecium but further lack anthers. This provides evidence that a male plant can be converted into a female plant by ablation of both its GDS gene and the male stimulator or asparagus defective in tapetum development gene (AS-TDF1). The skilled person will appreciate that the opposite effect, which comprises the introduction of both these genes into a female plant will likely result into a male plant. The skilled person will also appreciate that by only introducing the defective in Tapetum Development and Function gene (TDF1), thus not also including the DUF247 domain comprising M-locus linked suppressor gene of gynoecium development, into a female plant will change this female plant into a hermaphrodite plant.

Another independent, strong line of evidence that supports the TDF1 gene as being the male stimulator is an analysis of gene expression in all genes displaying sex linkage. A ~3.2 million SNP genetic map constructed using 72 individuals of a doubled haploid mapping population delimited a region of suppressed recombination on the Y that included 370 annotated gene models. By calculating normalized gene expression values for all 370 genes in this region of suppressed recombination (the M-locus region), we first identified 11 genes that had expression values <1 FPKM in at least 3 of the 4 XX female libraries, a reasonable cutoff to determine a gene as being non-expressed. Of these 11, we identify the gamma-irradiated DUF247 female suppression gene, and 10 putative male promoting candidate genes. Candidates were first objectively pruned on the basis of 1) expression in a female library, 2) presence of duplicate genes on an autosomal chromosome, 3) poor gene annotation (i.e., mis-annotated retrotransposons), 4) gene expression and knockout phenotypes in model systems. From the Harkess et al. (2015) study, only four of the male and supermales libraries (89 male, 9 male, 89 supermales, 103 male) were enriched with male reproductive gene expression, likely a consequence of variation in reproductive development between breeding lines. These four libraries show consistent upregulation of three of the 10 putative candidates, Lipid Transfer Protein DIR1, Tapetum Dysfunction 1 TDF1, and an Exopolygalacturonase protein. An LTP1 gene was found to have recombined in a breeding population (CN94/CN95-11RM; primer see Table 3) Exopolygalacturonases have only been loosely related to anther activity, and are members of a multi-gene family in *Asparagus*, allowing for the possibility of mis-aligned RNAseq reads due to high similarity between gene copies. The TDF1 gene, on the other hand, is single copy in the *Asparagus* genome and only present in this region of suppressed recombination on the Y.

The fact that AsOf TDF1-like is restricted to Male *Asparagus officinalis*, thus is absent in Female *Asparagus officinalis*, is a single copy Gene Model, is in close vicinity of the Female suppressor gene referred to as DUF247 from AsOf_V2.0_scaffold905, is genetically flanked by several DNA-markers (such as CE64/CE66-HRM; Table 3) and is expressed at higher levels in Males and Supermales poses strong evidence that AsOf TDF1-like is the Male-promoting gene as predicted by the two-gene model for the origin of sex chromosomes (Charlesworth & Charlesworth, 1979).

The gene is referred to as AsOf TDF1.

The genetic pathway for tapetum development is generally conserved, given the similarity between Arabidopsis *thaliana* and *Oryza sativa* (Cai et al., 2015, and references therein).

This is the case for both the crucial events of anther development, such as sporophytic wall differentiation, tapetal specialization, meiosis and pollen maturation as well as for the crucial regulators of these processes. In *Arabidopsis* and rice, transcription factors (TFs) that are essential for tapetum development and function have been identified. In *Arabidopsis* these include the bHLH family members DYSFUNCTIONAL TAPETUM (DYT1) and ABORTED MICROSPORES (AMS), the R2R3 MYB TFs DEFECTIVE in TAPETAL DEVELOPMENT and FUNCTION (TDF1) and MS188/MYB0 and PHD-finger protein MALE STERILITY (MS1). Rice homologs for these TFs include UNDEVELOPED TAPETUM (UDT1), TAPETUM DEGENERATION RETARDATION (TDR1), OsTDF1, OSMYB103/OsMYB80 and PERSISTENT TAPETUM CELL1 (PTC1). These regulators form a genetic pathway DYT1/UDT1→TDF1/OsTDF1→AMS/TDR→MS188/OsMS188 MS1/PTC1 In which TDR interacts with two other bHLH family members (bHLH142 and EAT1, see Cai et al., 2015). Both in *Arabidopsis* and rice, DYT1/UDT regulates the gene expression for pollen wall development of all downstream genes, primarily via TDF1/OsTDF1. Two lines of evidence using gene expression data to support the AsOf TDF1 being the male promoter in *Asparagus* were conducted: a forward genetic approach in which all genes displaying sex linkage were analyzed and a reverse genetics approach in which the conserved genetic pathway mentioned was used to analyse the expression of *Asparagus* homologs of the key regulators in *Arabidopsis* and rice.

The first approach (described in Harkess et al., 2015) a ~3.2 million Single Nucleotide polymorphism (SNP) genetic map constructed using 72 individuals of an *Asparagus Officinalis* DH mapping population (Limgroup, Horst, The Netherlands) delimited a region of suppressed recombination on the Y-specific region of the sex chromosome that included 370 annotated gene models. By calculating normalized gene expression values for all 370 genes in this region of suppressed recombination, 11 genes were not expressed in DH female lines; the DUF247 female suppression gene (the SGD gene (identical to SEQ ID:NO 1 and SED NO 3), and 10 putative male promoting candidate genes. Candidates were first objectively pruned on the basis of presence of duplicate genes on an autosomal chromosome, poor gene annotation (i.e., mis-annotated retrotransposons) and gene expression and knockout phenotypes in *Arabidopsis* and rice. Harkess et al. (2015) describe that only four of the male and supermales samples used in RNA-Seq experiments (89 male, 9 male, 89 supermales, 103 male) show differential male reproductive gene expression, likely a consequence of variation in reproductive development between breeding lines. The results show consistent upregulation of three of the 10 putative candidates that are *Asparagus* homologs of LIPID TRANSFER PROTEIN DIR1 LTP1), AsOf TDF1 (SEQ ID NO:4), and an Exopolygalacturonase protein. Exopolygalacturonases have only been loosely related to anther activity, and are members of a multi-gene family in *Asparagus*, allowing for the possibility of mis-aligned RNA-seq reads due to high similarity between gene copies. These results indicate that AsOf TDF1 is involved in male-specific gene expression. The second approach used the *Arabidopsis* and *Oryza sativa* sequences of the key regulators in the conserved genetic pathway for tapetum development to analyse candidate homologous gene models in *Asparagus* Genome Scaffold V2.0 (AGS V2.0) and annotation metadata. For this, tBLASTN was used with the protein sequences of the key regulators as Query in BLAST databases of AGS V2.0 and RNA-Seq Trinity de novo assemblies. The returned sequences with significant similarity scores were inspected and evaluated by BLASTP in standard settings with the translations of the candidates as Query in NCBI non-redundant protein databases of *Arabidopsis thaliana* and *Oryza sativa.*

For DYT1/UDT1 no significant tBLASTN hits were found in AGS V2.0 and one relevant hit in the Trinity assemblies: comp64619_c4_seq3 of 847nt. SEQ ID: NO 10 SEQ ID NO:10 comp64619_c4_seq3 of 847nt

CTCTCTCTCTCTCTCTCTGCAATTTACAAGTACTTCTTCTCCGTTGCTTG

TTAGCATTATTTGATAGCAATGCCTCGTTGGCCAAGAGACCAAGCCAAGG

AATTTGATGTGATGAACTTCGCAGACTCAATGCTTGATGGCTGCTACGGC

GATGGAGGAGGAGAAGGGGAGTTTCGGAAGGAGCAGTCCGCGGCTGCGGC

-continued

```
AGAGAAGGGAGAGGAAAGGTACAAGTCAAAGAACCTCGCAGCAGAGAGGA
GGAGGAGGAGCAAACTCAATCATCGACTCTTTACCCTCAGATCTTTGGTT
CCTAACATTACTAAGATGAGCAAGGAGTCAACCCTCATTGATGCAATGGA
TTACATCCACAACCTCCAAACACAAATTAGTGACCTGAAGCTTGAGATTT
CGAAGATTTGCGAAGAAGAGGACCGCACGAAGCAAGGGAGCACATCTAGT
ACAGAGAGCACAGCTCCTCCAGAGATGGCCCAATACCAGGGAAGGGTTGA
GCTGAATCCTATGGGACAAAACAAATTCCATGTTAAGATTATGTGCAACA
AGAGGCCTGGAGGGTTTATTAAACTGCTTGATGCCCTCTCCAGAAATGGA
CTAGAGATTACTGAAATCAGCTCCTTTGCTTTTTCAGGTTTTGATCAGAT
AGTTTTTTGCATTGAGGCAACGGGTGATAAGGAGATTCCCATTTCTGAGT
TAAGAAAGCTTCTAATGGCGATAGTCGAAGTATCTGAGGAGAATAATAAA
TGATTAATTTTAAATCATGTTCAATTGGTATTTGTATGAATAGATTGATT
TAGAGTTTGAACTTCAAAGTTTTCTGTGCTTTTATTTGCTTTAGTAA
```

When used as Query in BLASTP the top scoring sequences included the bHLH domain in AMS/TDR1 and TF SCREAM2 in *Arabidopsis*. It was concluded that DYT1/UDT1 has no significant homologous sequence in the used male databases.

For TDF1/OsTDF1, the homologous genomic sequence is described before and can be found in SEQ ID NO: The female sequence is absent and the expression is male-restricted upregulated (Harkess et al., 2015 and personal observations, Limgroup, Horst, The Netherlands).

For AMS/TDR1, one tBLASTN sequence was found in AGSV2.0: AsOf_V2.0scaffold2800 positions 121055 . . . 121735 with Identities 73/227 (33%) and positives 98/227 (44%). The AMS/TDR1 predicted cDNA is provided in SEQ ID NO:7

```
ATGAAGGTGTTGTCATATTCCAGCGTGGTTGAGGGTCTGAGGCCACTTGT
GGGTGGCAATGGCTGGGACTACTGCATCCTGTGGAAATTGTCTCAAGATC
AGAGGTTTTTGGAGTGGATGGGATGCTGTTGTAGCGGAACAGAGGCAAGC
ATTGCGAATGGTGGAGGGCTTTTCTCTGGTGATGAAACATTTCAGAAATC
ACCATGCAGGGATTTAATGCTGCAGCATCCAAGAACAAGGGCATGCGATG
CTCTCTCAGAGTTTCCTTCTTCCATCCCCTTGGATTCCTCTTTAGGCATT
TACGCACAAGTATTGATGTCGAACCAGCCAACTTGGCAAACACTTCATGA
TGCGGTTGGAGCAAAGACTAGGGTTCTTGTTCCTATTGCTGGTGGACTAG
TTGAGCTACTAGTCTCGAAGCAAGTTGCTGAGAACCAACAGATGACAGAC
TTCATCATGTCACAATGCAACGGGAGCATCTACGACCATCCAACTGCGGG
TAATTTCCTTGATGATCAGAGTTTCCAGTGGGAGGCATCCGCAGGTGGCC
AATCACAACCCTACGCATCTCCGATGAACATCTTCGACCAGTTGCAGCTC
GATGCGGCTGCAACAATGGACAGCACGGGGTACGGGCAGCAGGCAGGGCT
GACGAGTGTGCATCAGCAAAAGGAATCTGCTCCAGCGGAGAAGGAATCGG
TGAAACATGAGGGCGGCAGTGCGCGAGGAGATTCGGGGACGGAGGGGAGT
GAGGATGATGAGGAGGGGAGGGCGGTAGGGAAGAACGGGAAGCGGCATCA
TGCAAAGAATCTTGTGGCGGAGAGGAAGAGGAGGAAGAAGCTTAATGATC
GGCTCTACGCTCTCAGGGCCTTGGTTCCTAAAATCACAAAGATGGATAGA
GCATCGATTCTTGGAGATGCGATAGAGTATGTGATGGAGTTACAGAAGCA
GGTAAAAGATCTGCAGGACGAGCTCGAGAATGAATCAAATCCAGATGACA
CCGATTCAAAGCAAATCGAAAGCAACTATGACAATGTGGAAACAGGCAAT
CGAAATGGGATGATAAATTATAATCTCATGGAGCTTGAGGAGTCCCTTAA
CGCTACAAGTACGAGAAATGCTAAGACTGTTGATCAGTCGAACAATGAGG
AGAAGGGGAATCAAATGGAGCCACAAGTGGAGGTGAAGCAGCTGGAAGCT
AATGACTTCTACCTCAAGGTTTTTGTGAGCATAAGGTTGGAGGATTTGC
AAGGCTGATGGAGGCAATGAGCTCGCTTGGGCTGGAGGTGACCAATGCAA
GTGTGACTACTCTTCAGTCTTTAGTACTGAATGTTTTCAGGGTGCAGAAG
AGGGACAATGAAACGATGCAAGTCGATCAAGTCAGGGATTCATTGCTGGA
GCTGACTCGAGGGCCAATCCGAGGGTGGCCGGAGCCTGGACACACTACAG
AAAACCGCGGTGGAGATTGCCATCATGACAATGGTCTGCGGCCTACCGTG
GAGATTTGGAGAATTTTGATTGTCGTGTTGTGCCAAGCTGGCAACGTTCC
TTTGGGTTTTGGTTTGTTTGGAAAAATAATAGATTCGGGAAGTTTGCCGA
CTGTTGTGACGTATACGTTTCTTATTAAAGGGCTCCTAAAAGCTCGAATG
TTGAGCGAAGCGATTGGTGTTTGGGATATTATGGTCATTGCCTCCGTTGC
CGTCGACCGCCGCCTCGCCGCCCTCGACACGAAGCTATATTGA
```

Inspection of the alignment showed that the scores were the result of alignment in the conserved bHLH family domain. This sequence was different from an AMS-related sequence described by Harkess et al. (Harkess et al., 2015). In this study the AMS candidate RNA was male-restricted downregulated as expected for AMS/TDR1-like sequences. Inspection of AsOf V2.0scaffold2800 female read coverage of reference female DH00/094 and four doubled haploid females showed no significant reduction in read coverage (results not shown) which indicates that the AMS gene is not lacking in females For MS188/OsMS188, one highly significant sequence was found using tBLASTN in AGS V2.0: AsOf V2,0_scaffold3320 positions 107598 . . . 106444 rev. The predicted cDNA of sequence MS188/OsMS188 is given in SEQ ID NO:8.

```
ATGGGAAGGATTCCTTGCTGTGAGAAGGATAATGTGAAGAGAGGACAGTG
GACCCCCGAGGAGGACAACAAGCTCTCTTCCTACATCGCACAACACGGCA
CCCGAAACTGGCGTCTCATCCCCAAAAATGCCGGCCTTCAGAGATGTGGG
AAGAGCTGCCGGCTACGATGGACCAACTACCTCCGCCCGGATCTCAAGCA
CGGCGTATTCTCAGACTCCGAAGAGCAGACCATCGTCAAGCTCCACTCCG
TCGTCGGGAACAGGTGGTCGTTGATAGCAGGGCAACTGCCAGGGCGAACA
GATAACGATGTGAAGAACCACTGGAACACGAAGCTGAAGAAGAAGCTGTT
GGGCAAGGGTATCGACCCGGTGACCCACAAGCCCTTCTCCCATCTCATGG
CCGAGATTGCTACCACGGTTCCCCCGCTGCAAGTAGCCCACCTCGCTGAA
GCTGCCCTCGGCTGCTTCAAGGACGAAATGCTGCACCTCCTTACCAAGAA
GCGGGCGGATTTCCCTGCAAACGGTACTGATGTCGGTGATGGCACGGGCT
TCCCCTATGCAATGAGCCCCGTGGAGGACAAGGAAGAGACTGTTCAGAAG
```

-continued

ATCAAGCTAGGGCTCTCTCGAGCTATCATGCAGGAGCCTGGAACCGATAA

GAGCTGGGGCTTAATGGAGAACGGAGAGCCATCAGATGGGCTTCCTGTTG

TGTCAATGTGCGATGATGATTTGTATCGAACGATAGGGGATGAGTTCAGG

TACGAGGGACCATCGTATGCGAATGGCGAGGGGTCAGCATGGAGCCAGAG

CATGTGCACGGGTAGCACGTGCACTGGGGGCGGTGGAACACCAGACTGTC

ATGTATTGCACGAGAAACACAGTGACGACGAGGGGGTGGAGGCTGAAGGC

AAGAGGAGGAAAATCGATGCTGGGCTTTTCGGCTCTGATGGTGTTTTATG

GGATTTGTCTGATGACCTTATGATGAATCACATAG

Inspection shows near-full alignment of both protein sequences to the *Asparagus* homologous gene model and using BLASTP in non-redundant protein databases at NCBI returned MS188 for *Arabidopsis* and OsMS188 as highest scoring hits. In addition, the AsOf V2,0_scaffold3320 is well-covered by female specific read mapping making it possible to analyse gene expression in both males and females for this non sex-linked gene model. The RNA-Seq data show a strict male-biased expression for the gene model i.e. the read mapping is absent in female expression data. In the aforementioned RNA-Seq including in which the whole genome gene expression in flower buds obtained from different genotypes of *Asparagus* and of particular developmental stages was studied. From these data it was concluded that *Asparagus* MS188/OsMS1.88-like gene model is exclusively expressed in male phenotypes restricted at the pre-meiotic stage. The gene model and spatiotemporal expression at the pre-meiotic stage corresponds well to the MS188 and OsMS188 data (Gu et al., 2014, Cai et al., 2015). Therefore it was concluded that this gene model is the *Asparagus* homolog of MS188/OsMS188. The gene is referred to as AsOf MS188.

For MS1/PTC1, the data are comparable to those of AsOf MYB188. A significant hit was returned using tBLASTN in AGS V2.0: AsOf V2.0 scaffold2421 positions 133601 . . . 134341. The predicted cDNA sequence MS1/PTC1 is given in SEQ ID NO:9:

ATGGAGAAGGTTCAATCTTGCTCTAGAAAGAGGAAAAGAGGAGAGAAGGT

TTTCAGATTCGAGAGCTTCTGTGCACCTAGGCAACCAATACTTTTCAGTG

GCTCGTTCCGAGACAACGTTAAGGCTCTTCTTGATTTCGGCCATCAAGAG

GATGGAGTGCACGAAGGAATGCAGTTTTGGTCGTTTCGGCTCGAGCTTCA

TCAGTACCCTTCGACTTTCGTGAGGATGTTCGTTGCTGAGGAGGCTGTTG

GGCTGTCGCAGAATCGCCAGTGCCTTTTTTGCCGATTCGCTGGTTGGGGG

CACCACATGATCTCCAACAAGAGATTCCACTTCGTGCTGCCATTCAAAAA

AACTAAATCAGAGGTCGAAAGCTTGAGCATAGAACTTGGTAGAAACAGAC

CAGGGATATCGTCAATGGGCTCGAAATTGATGGGTTCACAAGGAAAGCAT

CTAATGCATGGAATCATGCACTCTAATGGCTACGGACATCTCATTACTGT

CAATGGCATTGAAGGAGGCTCTGATTTCATCTCTGGACATCAAATCATGG

ACTTGTGGGATAGGATTTGCACTGCTTTGCATGTGAGAAAAGTGAGTATA

ACAGATTCAGCAAAGAAGGGAAGCATGGAACTAAGGCTAATTCATGGACT

AGTGTATGGTCAGCCCTGGTTCAGTCGCTGGGACTACAAACTAAGCCATG

GAAGCTATGGCGTCACTCCCCAAATGTACCAAACCTCGCTCGAAGCCCTA

-continued

CGAACTCTCCCCTTATCAATCCTCCTCCCCAATTTCGCCTCTATCATTGC

CAAGTACCAAACCCTAAGTGGGCTCAAGTTACAAACCATAGCCGACTTAA

CCTGCTTCATTACAGAGCTGAATCGTCGATTGCCCCCAAACACCCCTTCG

ACATTCGACTGTCGAGAAATCATCAGCGAGCCAACTTGTCGTTGGTCGAT

GAAACGAGTTGAGATGGCTGCTCAAGTCATAGTCGGGGCTCTAAAGAAGT

CCAAATGTCGTTGGGTCACAAGACAAGAGGTCAGAGATGCCGCCAGAGCC

TACATTGGTGACACAGGCCTACTAGACTACGTGCTCAAGTCTCTCGGCAA

CCACATTGTTGGAAACTATGTTGTTCGACGGATGGTCAACCCGATAACCA

AAATACTTGAATACTGCTTGCAGGATGTATCTACTGTTTTCCCTAGCTTG

GATCATTTCGGTTCACTTCGTTTTCATGTCACAAGGTCTCAGCTCAAGAA

AGACATGATGTACCTCTACAATAACATATTTGGAGCACATAGCACATTGG

CTGCCGATGGGGTTTTCAGGGCAATACTTATCGCTGCTCGGGTGATTCTC

GACGCCAAACACCTTGTTAAGGATTACAAGGTGACAGGTGGCTCGTTACA

AGACACCCAAATGAAGAACAATGATCAATGTTTAAAGGTAATGTGCACGA

TACGAATCATGAACAATCAAGAGAAGAAGGAACTGCCACCATATGAGATG

TTCACCTTTCAGCTCAATGCAACAATTGGGGACCTGAAGAGAGAGACTGA

AAAAAAGTTCAGGGAAATCTATTTGGGCCTGAAGAGCTTCACTGCAGAAT

CAGTGGCTGGTCTTAATGCTGAAGATACTGATTTCATTGTAGGAGTACTT

GTTGAGCTTGGCAACAAAGTGATTGTTGAAGGAAGAGTAGTTAATAATGC

TGATGAGATTTATGAGGGTGGAAAAGATGTGGATTGCCATTGCGGAGGGA

AGGAGGAGGATGGAGAGGTGATGGTGTGCTGCGATATCTGTGGGATTTGG

CAGCATGCAAGGTGTGCAGGGATTGAGGACGAAGAAGAGGATGTTCCTAG

GGTTTTTCTCTGTAACCTATGCGAGAACAATATTTCCGCATTGCCTCCAA

TTCAATACTAG

Inspection shows near-full alignment of both protein sequences to the *Asparagus* homologous gene model and using BLASTP in non-redundant protein databases at NCBI returned MS1 for *Arabidopsis* and PTC1 (Os09g0449000) as highest scoring hits. In addition, the AsOf V2,0_scaffold2421 is well-covered by female specific read mapping making it possible to analyse gene expression in both males and females for this non sex-linked gene model. The RNA-Seq data show a strict male-biased expression for all four exons of the gene model i.e. the read mapping is absent in female expression data. Some aspecific read mapping occurs both in males and females. In the aforementioned RNA-Seq including in which the whole genome gene expression in flower buds obtained from different, genotypes of *Asparagus* and of particular developmental stages was studied. From these data it was concluded that the *Asparagus* MS1/TCP1-like gene model is exclusively expressed in male phenotypes restricted at the pre-meiotic stage. The gone model and spatiotemporal expression at the pre-meiotic stage corresponds well to die MS1 and PCT data (Gu et al., 2014, Cai et al., 2015). Therefore it was concluded that this gene model is the *Asparagus* homolog of MS1/PCT1. The gene is referred to as AsOf MS1. Notably, the male-biased, RNA-seq read mapping of AsOf MS1 is absent in line 9M (Limgroup, Horst, The Netherlands). This was due to the small amount of flower buds sampled some particular stages. In conclusion the regulatory network reveals: DYT1/UDT (no reliable predictions)→TDF1/OsTDF1/AsOf TDF1→AMS/TDR1(?)→MS188/OsMS188/AsOf MS188→MS1/PTC1/AsOf MS1

The fact that AsOf TDF1-like is restricted to Male *Asparagus officinalis*, thus is absent in Female *Asparagus officinalis*, is a single copy Gene Model, is in close vicinity of the Female suppressor gene referred to as of the Gynoecium Development Suppressor (GDS gene) or the DUF247 domain containing gene from AsOf_V2.0_scaffold905, is genetically flanked by several DNA-markers, is expressed at higher levels in Males and Supermales and is part of a well-studied genetic pathway for tapetum development for which *Asparagus* homologs show the expected spatio-temporal expression patterns, poses strong evidence that AsOf TDF1-like is the male-promoting gene as predicted by the two-gene model for the origin of sex chromosomes (Charlesworth & Charlesworth, 1979). In addition, one can safely conclude that complementing a female asparagus plants with AsOf TDF1 will restore a functional androecium development.

Cai et al (2015) have demonstrated the expression of OsTDF1 in *Arabidopsis* tdf1 mutant restores its fertility, suggesting that this homolog can fulfill the normal function of TDF1 in *Arabidopsis*. The rice OsTDF1 gene and the *Arabidopsis* TDF1 gene have been shown to be quite different but conserved in the R2R3 MYB motif. This knowledge combined with the knowledge disclosed in the present document indicates that a female asparagus plants with complemented with a homolog or ortholog of AsOf TDF1 may also restore a functional androecium development.

TABLE 61

Result of BioNano Genomics contig assembly of Asparagus officinalis genotype DH00/086 (Male) and AGS V2.0 Scaffolds using the Irysview Software ® package. Based on genetic marker information, 16 AGS V2.0 scaffolds were selected (sex-linked) as Query and yielded 8 different BioNano contigs (7, 22, 28, 55, 438, 833, 1030, and 1138) or no contig (0). The table shows that 7 sex-linked scaffolds matched to BNG V1.0 contig 28 and 4 scaffolds not detected by genetic marker screening (new) matched to contig 28 as well. Based on matching information it was concluded that at least 7 M-locus scaffolds were chimeric assemblies.

| AGS V2.0 scaffold Query_id | BNG V1.0 contig Anchor_id | Genetic marker information | Match information |
|---|---|---|---|
| 206 | 28 | sex linked | chimeric |
| 422 | 1030 | sex linked | |
| 436 | 28 | new | chimeric |
| 905 | 28 | sex linked | |
| 945 | 28 | sex linked | chimeric |
| 997 | 222/28 | sex linked | chimeric |
| 1139 | 7 | sex linked | chimeric |
| 1166 | 1138 | sex linked | chimeric |
| 1194 | 28 | sex linked | |
| 1204 | 28 | sex linked | chimeric |
| 1279 | 833 | sex linked | |
| 1539 | 28 | sex linked | |
| 1742 | 458 | sex linked | |
| 1761 | 0 | sex linked | |
| 2312 | 28 | sex linked | chimeric |
| 2510 | 28 | new | |
| 3098 | 0 | sex linked | |
| 3294 | 28 | new | |
| 3779 | 28 | new | |
| 5266 | 0 | sex linked | |

Example 7

Feminized Plants (Including Females) Created by Gamma Irradiation; their Fruit Set, their Flowers, their Proven Mutations In the present EXAMPLE 7 more details are provided on the mutants plant obtained by gamma irradiation described in EXAMPLE 6

At the time of writing research was ongoing. The text below provides a record of what is currently known. It should be noted that the plants at the time of both the first and second evaluation have suffered from a *Prodiplosis longifila* infection and that therefore the fruit set could have been higher, compared to what has been reported for those plants. The second evaluation took place in December 2015 in a warm period that may also negatively affect fruit set For all mutants HRM analyses was performed on their DNA as described in EXAMPLE 6 which, apart from the male-to female transgenders, showed only a melting curve difference for K1150_300_11 that indeed had a mutation (see below). To be certain that some mutations had not been missed (such as A→T type 4 SNPs) by HRM, the gene region was sequenced for all mutations but K1150-600-2 (sent for massive parallel sequencing) using primers CN86/CN87, CN88/CN89, CP41/CN60, CN59/CN70, CN67/CN82, CN69/CN81 (Table 3). Only one mutant showed a SNP in a sequence obtained by CN86/CN87 outside the translated region and the region targeted by the HRM marker. This illustrates that extending sequencing outside the translated region may allow the detection of more mutants. However, as has been noted before a region upstream the gene, for which PAB BIO reads showed AT rich repetitive DNA flanked by GC rich island (results not shown). A region comprising repeats may contain cis-regulatory elements such as have been shown for the Arahidopsis Fwa gene (Soppe et al 2000). The authenticity of all mutants have at least been proven by markers AO008, AO022, AO058, AO069, AO097, AO110, AO145 and showed no impurities apart from K323-_600A3. This number of loci is sufficient to call any impurity (unpublished results). However, especially for the (female) mutants that were subjected to costly genome sequencing, more markers have been applied such as shown in FIG. 21.

Figure 22:
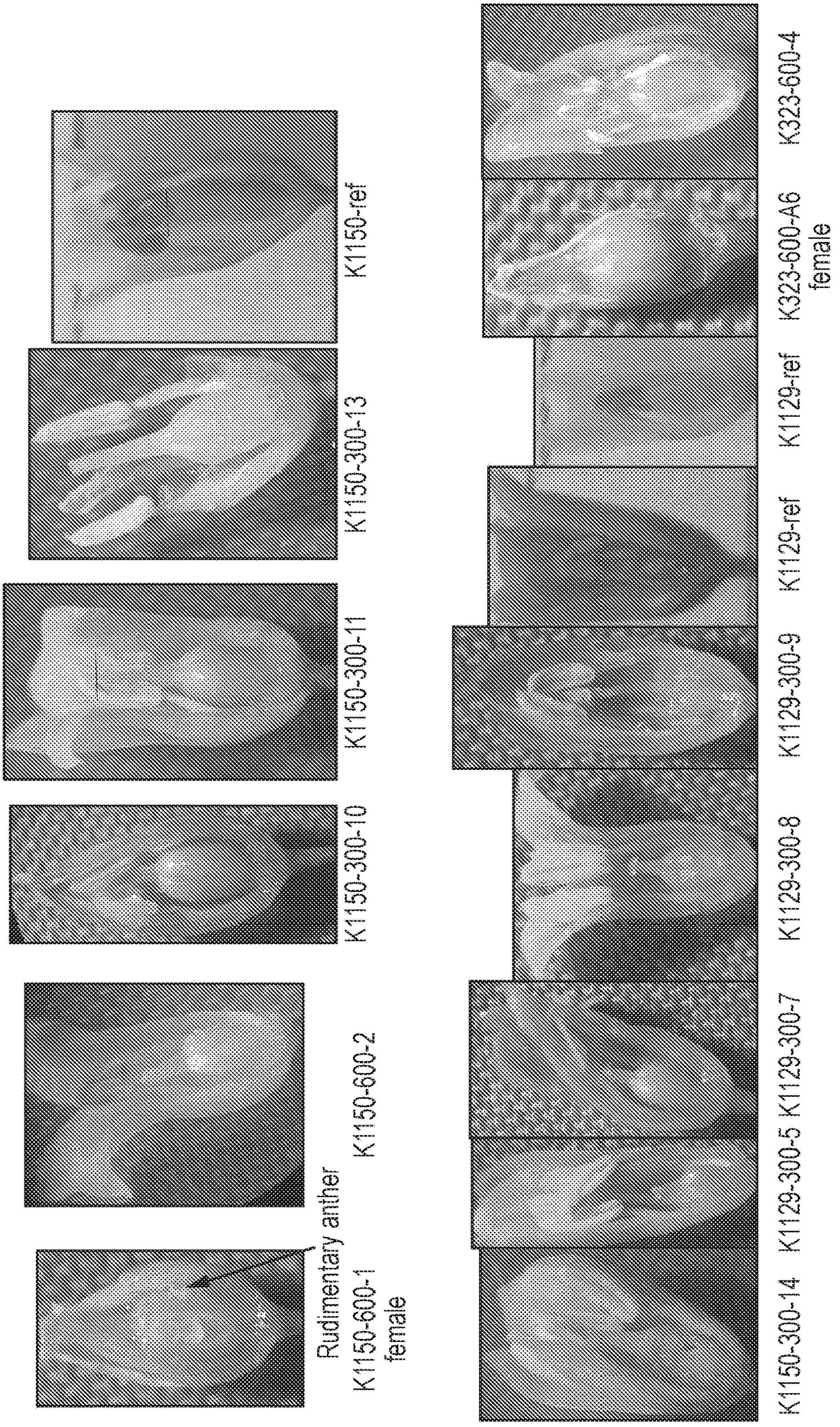

K1150-600-1 is a female also described in EXAMPLE 6, it has shown a deletion comprising the GDS and AS-TDF1 gene. A first inspection its female flowering was recorded but poorly photographed. Several weeks later, the plant again produced female flowers of which one has been photographed which is shown in Figure. 22, Berries were found on three stems, two bore 5 and one bore 4 berries, nine ripe berries provided 11 viable seeds. Four months later, after cutting of the fern, the plant was found to have produced 152 new berries that are currently ripening K1150.600-2, produced 5 stems (having 4, 2, 14, 57, and 4 berries each) of which four were ripen that provided five viable seeds several weeks later a flower was photographed FIG. 22. The flower showed a style and stigma development that was not exceptional for this hybrid. Recently, K1150-600-2 produced 20 new berries that are ripening. Genome resequencing suggest a small candidate deletion staring at position 1449 to 2023 which, because of PCR failure using primers CN88/CN89, CN86/CN87 and CN62/CN68 (Table 3), provided no conclusive evidence to date of such deletion. Sequencing the GDS region of this mutant is pending.

K323-600A-3, had no young flowers at the first time of evaluation and produced four stems that had (21, Ca 100, 1 and 11 berries respectively. This mutant was later classified as false because it appeared a seed contamination (FIG. 21).

K323 600A-4 has finished flowering and then was found to have produced three stems with 2, 1, and 4 ripened berries respectively that provided 8 viable seeds. No new berries have been obtained for K323 600A-4 in new shoot flush.

K1129.300-5 had one stalk producing two ripe berries from which two viable seeds were obtained. A flower of the plant was obtained in a new flush (FIG. 22). The image showed a very well developed tri-lobular stigma, which was not observed on a reference flower of the hybrid. Recently, this plant was reported to have produced 26 new berries.

K1129-300-7 had produced one stem that comprised 3 ripe berries from which 4 viable seeds have been obtained, its photograph shows a style with some stigma development (but likely less compared to K1129-300-5). Recent inspection of the plants new shoots revealed no new fruit set K1129-300.8 was found to have produced one ripe berry and in a next flush providing a single viable seed. The flower of this plant is shown in FIG. 22. It was noted that this flower also has a very well developed stigma. Sanger sequencing K1129.300-8 using primer pairs CN86/CN87 revealed an adenine to thymine change identical to nucleotide position 1160 of SEQ ID NO:3. This adenine to thymine change is separated by 665 nucleotides from the adenine of the first predicted start codon of the GDS gene. This conclusion an adenine to thymine is inferred from a comparison sequence information obtained for the K1129 reference hybrid, and of other plants such as K1036 (the genotype of EXAMPLE 6) breeding line 9M, and hybrid K1150 reference genome doubled haploid DH00/086. The likelihood of detecting such a mutation by chance alone in this region must be extremely small and therefore it is anticipated that such a mutation may have enabled K1129.300-8 to produce at least one berry. Further investigation is pending. Thus far, no new berries have been obtained in the second flush of stems.

K1129-300-9 produced one ripe berry comprising one viable seed. A photograph taken revealed no marked style development (FIG. 22) and it so far has not been reported to produce new berries.

K1150-300.10 had a single stem on which three ripe berries were found from which two viable seeds have been obtained. It showed a relatively large fruit. The plant so far was not reported to have any newly produced berries.

K1129-300.11 had three stems on which (1, 2, and 3) berries were found for which only one viable seed was obtained. A picture was taken of a flower from the second shoot flush (FIG. 22) which showed an exceptionally long style, nearly topping its anthers. To date, new shoots have not provided new berries. High resolution melting analysis using primer pair CP41/CN72, produced an off-type melting curve for plant K1150_300_11 compared to other individuals belonging to cultivar K1150, Sanger Sequencing using the primer pairs CN69/CN81 (Table 3, EXAMPLE 1) revealed an adenine to a guanine change comparable to the positon of 1193 of 1160 of SEQ ID NO:1. which leads to a asparagine (N) to serine (S) amino acid change. This SNP was absent in a sequence obtained for the K1150_300 reference hybrid and many reference sequences such as DH00/086, hybrid K323 and 88M, 5375, 9M etc. and is considered unique. Because this mutant, capable of producing berries, has the amino acid changed in of gynoecium development suppressor this differentiates it from the original K1150 which is not capable of producing berries. Accordingly, it is concluded that this particular mutation provides a feminized plant.

K1150.300-12 had two stems comprising 174 and 6 berries from which >200 viable seeds were collected. The plants has finished flowering at the time of inspection and after cutting the fern to obtain new shoots, the plant has not recovered. Further investigation will take place on twelve seedling currently growing in the greenhouse obtained from these berries. Fortunately, tissue was taken for DNA isolation prior to cutting the fern and, as disclosed in EXAMPLE 6, a deletion comprising the GDS and the male stimulator gene was proven to exist. The lack of new flowers so far has hampered confirmation of its expected female phenotype. Future research aimed at obtaining new flowers from the pedigree of this plant may further confirm the association between the deletion and a female flower phenotype are pending.

K1150-300-13 had a stem on which three ripe berries were found from which 11 viable seeds have been obtained. An image of one of its flowers (FIG. 22) showed a very long style. On recently formed new shoots 18 new berries have been reported K1150-300-14 produced two stems on which 3 and 4 ripe berries were found that produced 6 viable seeds. A flower (from which part of the ovary was cut) is shown (FIG. 22). No berries, thus far, have been obtained from new shoots. No flowers to be photographed have been obtained.

K1150.300-15 had a stem on which a single ripen berry was found that did not have (registered) viable seed.

K1150.300-16 had a stem on which a single ripen berry was found comprising two viable seeds. Is was recently found to have produced three new berries on a the second flush of stems.

Recently, more flower have been collected for reference plants of hybrid K1129. It was noted that those plants have not developed any style or very small.

This suggest that the style development as has been shown for K1129.5 and K1129-8 is quite exceptional

REFERENCES

Altschul S F, Gish W, Miller W, Myers E, Lipman D (1990). Basic local alignment search tool. Journal of Molecular Biology 215 (3):403-410.

von Beeskov, H.

Untersuchungen über die Variabilität der Adrnomonözie/Diözie and ihre Korrelationionen met verschiedenen Ertragsfaktoren bei Sparege (*Asparagus off.* L.) unter besondere Berücksichtigungen der Züchting rein männlicher Sorten). Z. PlfZucht 57:254-283Bos I (1985). Selectiemethoden Deel A. Populatie-genetische grondslagen. Landbouw Hogeschool Vakgroep Planten verdeling Wageningen. A remark on full sib mating and its inbreeding efficiency compared to self-fertilization based on theoretical ground is presented in Dutch on page 29.

Bracale M, Galli M G, Falavigna A, Soave C (1990). Sexual differentiation in *Asparagus officinalis* L. II. Total and newly synthesized proteins in male and female flower. Sex. Plant Reprod. 3:23-30.

Bracale M, Caporali E, Galli M G, Longo C, Marziani-Longo, G. Rossi G, Spada A, Soave C, Falavigna A, Raffaldi F, Maestri Brown, TA (2002). Mapping genomes. Genomes, 2nd edition, Wiley-Liss, Oxford. ISBN-10: 0-471-25046.

Shelton, J M et al. (2015). Tools and pipelines for BioNano data: molecule assembly pipeline and FASTA super scaffolding tool. BMC Genomics 16:734.

Bracale M, Caporali, E, Galli, M G, Longo C,. Marziani-Longo C G, Rossi G, Spada A, Soave C, Falavigna A Raffaldi F, Maestri E, Restivo F M, Tassi F (1991). Sex determination and differentiation in *Asparagus officinalis* L. Plant Science 80:67-77.

E. Caporali, Carboni A, Galli M G, Rossi G, Spada A,. Marziani Longo G P. Development of male and female flower in *Asparagus officinalis*. Search for point of transition from hermaphroditic to unisexual developmental pathway. Sexual Plant Reproduction July 1994, Volume 7, Issue 4, pp 239-249 Briggs, FN, Knowless, PF. (1967) Rheinhold Publishing Corparation Cai Ci-Feng, Jun Zhu, Yue Lou, Zong-Li Guo Shuang-Xi Xiong, Ke Wang, Zhong-Nan Yang The functional analysis of OsTDF1 reveals a conserved genetic pathway for tapetal development between rice and *Arabidopsis* Sci. Bull. (2015) 60(12):1073-1082 www.scibull.com DOI 10.1007/s11434-015-0810-3

Charlesworth B, Charlesworth D (1978). A model for the evolution of dieocy and gynodioecy. The American Naturalist 112 (988):975-997.

Caruso, M, Federici, C T, Roose, M L,. EST-SSR markers for asparagus genetic diversity evaluation and cultivar identification. Mol. Breed. 2008, 21, 195-204.

Dalakouras A, Dadami E, Zwiebel M, Krczal G, Wassenegger M.

Transgenerational maintenance of transgene body CG but not CHG and CHH methylation. Epigenetics. 2012 September; 7(9):1071-8. Epub 2012 Aug. 6.

Doyle, J. J. and J. L Doyle. 1990. A rapid total DNA preparation procedure for fresh plant tissue. Focus 12:13-15.

Ellinghaus D, Kurtz S, Willhoeft U (2008). LTRharvest, an efficient and flexible software for de novo detection of LTR retrotransposons. BMC Bioinformatics 9:18.

Elsik C G, Mackey A J, Reese J T, Milshina N V, Roos D S, Weinstock G M (2007). Creating a honey bee consensus gene set. Genome Biology 2007, 8:R13.

English, A C et al. (2012). Mind the Gap: Upgrading Genomes with Pacific Biosciences RS Long-Read Sequencing Technology. PLoS ONE 7(11): e47768. doi: 10.1371/journal.pone. 0047768.

Evans D A, Bravo J E (1986). Phenotypic and Genotypic Stability of Tissue Cultured Plants. Tissue culture as a plant production system for horticultural crops. Current Plant Science and Biotechnology in Agriculture 2:73-94.

Evans, D A, Sharp, W R, Medina-Filho, HP Somaclonal and Gametoclonal Variation. American Journal of Botany Vol. 71, No. 6 (July, 1984), pp. 759-774

Franken A A (1969) Geslachtskenmerken en geslachtsovererving bij asperge. Proefschift Landbouw Hogeschool. Pudoc Centrum voor Landbouwpublikaties and Landbouwdocumentatie Franken AA (1970). Sex characteristics and inheritance of sex in asparagus (*Asparagus officinalis* L.). Euphytica 19:277-287.

Gady A L, Hermans F W, Van de Wal M H, van Loo E N, Visser R G, Bachem C W. Implementation of two high through-put techniques in a novel application: detecting point mutations in large EMS mutated plant populations. Plant Methods. 2009 Oct. 7; 5:13. doi: 10.1186/1746-4811-5-13.

Greaves I K, Groszmann M, Wang A, Peacock W J, Dennis E S. Inheritance of Trans Chromosomal Methylation patterns from *Arabidopsis* F1 hybrids.

Proc Natl Acad Sci USA. 2014 Feb. 4; 111(5):2017-22. doi: 10.1073/pnas. 1323656111. Epub 2014 Jan. 21.

Haas B J, Salzberg S L, Zhu W, Pertea M, Allen J E, Orvis J, White 0, C Buell R, Wortman J R (2008). Automated eukaryotic gene structure annotation using EVidenceModeler and the Program to Assemble Spliced Alignments. Genome Biology 2008, 9:R7.

Hoff K J, Stanke M (2013). WebAUGUSTUS—a web service for training AUGUSTUS and predicting genes in eukaryotes. Nucleic Acids Res. 2013 July; 41(Web Server issue): W123-8.

Jamsari A (2003). Construction of high-density genetic and physical maps around the sex gene M of *Asparagus officinalis* L. Doctoral Thesis. Institute für Planzenzüchting. Agrar-und Ernährungswissenschaftlichen Fakultät der Christian-Albrechts-Universität zu Kiel.

Jamsari A, Nitz I, Reamon-Büttner S M, Jung C (2004). BAC-derived diagnostic markers for sex determination in asparagus. Theor. Appl. Genet. 108 (6):1140-1146.

Jiang W, Zhou H, Bi H, Fromm M, Yang B, Weeks D P (2013). Demonstration of CRISPR/Cas9/sgRNA-mediated targeted gene modification in *Arabidopsis*, tobacco, sorghum and rice. Nucleic Acids Res. 2013 November; 41(20): e188. doi: 10.1093/nar/gkt780. Epub 2013 Sep. 2.

Jiang, C., Mithani, A., Gan, X., Belfield, E. J., Klingler, J. P., Zhu,. J.-K., . . . Harberd, N. P. (2011). Regenerant *Arabidopsis* Lineages Display a Distinct Genome-Wide Spectrum of Mutations Conferring Variant Phenotypes. *Current Biology,* 21(16), 1385-1390. http://doi.org/10.1016/j.cub. 2011.07.002

Jin and Martin (1999). Multifunctionality and diversity within the plant MYB-gene family. Plant Mol Biol. November; 41(5):577-85.

Kanno A, Kubota, S Ishino, K. (2013). Conversion of a male-specific RAPD marker into an STS marker in *Asparagus officinalis* L. Euphytica, 197 (1):39-46.

Kent W J (2002). BLAT-the BLAST-like alignment tool. Genome Res. 12, 656-664.

Korf I (2004). Gene finding in novel genomes. BMC Bioinformatics. 2004; 5:59.

Daehwan Kim, Pertea G, Trapnell C, Pimentel H, Kelleyand R, Salzberg (2013). TopHat2: accurate alignment of transcriptomes in the presence of insertions, deletions and gene fusions. Genome Biology 14: R36.

Langmead B, Salzberg SL (2012). Fast gapped-read alignment with Bowtie 2. Nat. Methods. 9 (4):357-359.

Lazarte J E, Palser B F (1979). Morphology, vascular anatomy and embryology of pistillate and staminate flowers of *Asparagus officinalis*. Amer. J. Bot. 66:753-764.

López-Anido F, Cointry E (2008). *Asparagus*. Handbook of Plant Breeding, 2: Volume package: Vegetables Vegetables II. Fabaceae, Liliaceae, Solanaceae, and Umbelliferae. Prohens-Tomás, J, Nuez, F (Eds.) XI, 365 p.

Löptien H (1976). Giemsa-Banden auf Mitosechromosomen des Spargels (*Asparagus officinalis* L.) und des Spinats (*Spinacia oleracea* L.). Z. Pflanzenzüecht. 76:225-230.

Longin C F, Utz H F, Reif J C, Wegenast T, Schipprack W, Melchinger A E. Hybrid maize breeding with doubled haploids: III. Efficiency of early testing prior to doubled haploid production in two-stage selection for testcross performance. Theor Appl Genet. 2007 August; 115(4): 519-27. Epub 2007 Jun. 29. Li H and Durbin R (2009). Fast and accurate short read alignment with Burrows-Wheeler Transform. Bioinformatics, 25:1754-60.

Li, H. (2013). Aligning sequence reads, clone sequences and assembly contigs with BWA-MEM. arXiv.org.

Ji L, Neumann D A, Schmitz R J. Crop Epigenomics: Identifying, Unlocking, and Harnessing Cryptic Variation in Crop Genomes. Mol Plant. 2015 June; 8(6):860-70. doi: 10.1016/j.molp. 2015.01.021. Epub 2015 Jan. 29.

Liang C, Mao L, Ware D, Stein L (2009). Evidence-based gene predictions in plant genomes. Genome Res. 19(10): 1912-1923.

Ruibang Luo, Binghang Liu, Yinlong Xie, Zhenyu Li, Weihua Huang, Jianying Yuan, Guangzhu He, Yanxiang Chen, Qi Pan, Yunjie Liu, Jingbo Tang, Gengxiong Wu, Hao Zhang, Yujian Shi, Yong Liu, Chang Yu, Bo Wang, Yao Lu, Changlei Han, David W Cheung, Siu-Ming Yiu, Shaoliang Peng, Zhu Xiaoqian, Guangming Liu, Xiangke Liao, Yingrui Li, Huanming Yang, Jian Wang, Tak-Wah Lam and Jun Wang (2012). SOAPdenovo2: an empirically improved memory-efficient short-read de novo assembler. GigaScience 1:18.

Machczynska J, Ortowska R, Mankowski D R, Zimny J, and Bednarek P T. (2014). DNA methylation changes in triticale due to in vitro culture plant regeneration and consecutive reproduction. Plant Cell Tiss. Organ Cult. 119:289-299.

Maeda T, Ozakit Y, Sonoda T, Inoue N, Narikly K, Okubo, H (2005). Sex-conversion from Male to Female during Somatic Embryogenesis from Protoplasts in *Asparagus* (*Asparagus officinalis* L.). Journal of the Faculty of Agriculture, Kyushu University 50(2):585-592.

Marks G E (1979). Hermaphrodites, do they have a role in asparagus breeding? Proceeding of the 5th International Asparagus Symposium, G. Reuther, ed., Eucarpia, Geisenheim, pp 39-41.

Martin A, Troadec C, Boualem A, Rajab M, Fernandez R, Morin H, Pitrat M, Dogimont C, Bendahmane A (2009). A transposon-induced epigenetic change leads to sex determination in melon. Nature 461 (7267):1135-8.

Müllner, D (2013). Fastcluster: Fast Hierarchical, Agglomerative Clustering Routines for R and Python. Journal of Statistical Software 53, no. 9, 1-18.

Nunna S, Reinhardt R, Ragozin S, Jeltsch A. Targeted methylation of the epithelial cell adhesion molecule (EpCAM) promoter to silence its expression in ovarian cancer cells. PLoS One. 2014 Jan. 29; 9(1): e87703. doi: 10.1371/journal.pone.0087703. eCollection 2014

Novák P, Neumann P and Macas J (2010). Graph-based clustering and characterization of repetitive sequences in next-generation sequencing data. BMC Bioinformatics 11:378.

Novák P, Neumann P, Pech J, Steinhaisl J, Macas J (2013). RepeatExplorer: a Galaxy-based web server for genome-wide characterization of eukaryotic repetitive elements from next generation sequence reads. Bioinformatics, Advance Access publication Feb. 1, 2013.

Ozaki, Y. T. Tashiro and H. Okubo 2000a Use of allozyme variation for evaluating genetic purity in asparagus (*Asparagus officinalis* L.) cultivars. J. Hort. Sci. Biotech., 75: 105-110

Ozaki, Y. T. Tashiro and H. Okubo 2000b Linkage arrangement of allozyme loci in asparagus (*Asparagus officinalis* L.). J. Japa7b. Soc. Hort. Sci., 69: 440~42

Peirce L C, Currence T T (1962). The inheritance of hermaphroditism in *Asparagus officinalis*. Proc. Am. Soc. Hort. Sci 80:368-376.

Lincoln C. Peirce (e-mails from 2010 and 2015). The address of emeritus Professor Lincoln C. Peirce was obtained from Elizabeth Slomba, University Archives, University of New Hampshire, on Oct. 19, 2010 Subsequently, a conversation by e-mail took place which provided the citations from Lincoln C. Peirce that were used by his permission.

Peng, M, Wolyn, D J Development of a microspore culture method to produce haploid and double-haploid asparagus (*Asparagus officinalis* L.) plants. ActaHortic. 1999.479.49

Peng Y, Leung HC, Yiu SM, Chin FY (2012), IDBA-UD: a de novo assembler for single-cell and metagenomic sequencing data with highly uneven depth. Bioinformatics. 2012; 28:1420-1428.

Pedersen, B. S., Eyring, K., De, S., Yang, I. V., & Schwartz, D. A. (2014). Fast and accurate alignment of long bisulfite-seq reads. arXiv: 1401.1129v2.

Pontaroli A C, Camadro E L (2005). Somaclonal variation in *Asparagus officinalis* plants regenerated by organogenesis from long-term callus cultures. Genet. Mol. Biol. 28 (3):423-430.

Qiao Y M and Falavigna A (1990). An imporived in vitro anther culture method for obtaining doubled-haploid clones of *Asparagus* Acta Hort. (ISHS) 271:145-150.

Smulders M J M, de Klerk G J (2011). Epigenetics in plant tissue culture. Plant Growth Regul. 63:137-146.

Soppe W J, Jacobsen S E, Alonso-Blanco C, Jackson J P, Kakutani T, Koornneef M, Peeters A J. The late flowering phenotype of fwa mutants is caused by gain-of-function epigenetic alleles of a homeodomain gene. Mol Cell. 2000 October; 6(4):791-802.

Sinner et al. (2009). JBrowse: A next-generation genome browser. Genome Res. 19:1630-1638.

Stroud, H., Do, T., Du, J., Zhong, X., Feng, S., Johnson, L., . . . Jacobsen, S. E. (2014). The roles of non-CG methylation in *Arabidopsis. Nature Structural & Molecular Biology,* 21(1), 64-72. http://doi.org/10.1038/nsmb. 2735

Trapnell C, Williams B A, Pertea G, Mortazavi A, Kwan G, van Baren M J, Salzberg S L, Wold B J, Pachter L (2010). Transcript assembly and quantification by RNA-Seq reveals unannotated transcripts and isoform switching during cell differentiation. Nature Biotechnology 28 (5): 511-515.

Trapnell C, Roberts A, Goff L, Pertea G, Kim D, Kelley D R, Pimentel H, Salzberg S L, Rinn J L, Pachter L (2012). Differential gene and transcript expression analysis of RNA-seq experiments with TopHat and Cufflinks. Nature Protocols 7:562-578.

Riccardi P, Longo C, Mercati F, Sunseri F, Leebens-Mack J H, Falavigna A (2010). Sex inheritance in *Asparagus*: A hermaphrodite doubled haploid line confirms and old theory? Proceedings of the 54th Italian Society of Agricultural Genetics Annual Congress. Matera, Italy 27/30 Sep. 2010. ISBN 978-88-904570-0-5.

Rick C M, Hanna G C (1943). Determination of sex in *Asparagus officinalis* L. Amer. J. Bot. 30: 711-714.

Sievers F, Wilm A, Dineen DG, Gibson T J, Karplus K, Li W, Lopez R, McWilliam H, Remmert M, Söding J, Thompson J D, Higgins D G (2011). Fast, scalable generation of high-quality protein multiple sequence alignments using Clustal Omega. Molecular Systems Biology 7:539.

Shen L1, Waterland R A. Methods of DNA methylation analysis.

Curr Opin Clin Nutr Metab Care. 2007 September; 10(5): 576-81.

Sneep (1953a) The significance of andromonoecy for the breeding of *Asparagus officinalis* L. Euphytica 2 (2):89-95

Sneep (1953b). The significance of andromonoecism for the breeding of *Asparagus officinalis* L. II Euphytica 2, (3), 224-228

Sneep J, Hendriksen A J T (1979). Plant breeding perspectives. Centennial publication of Koninklijk Kweekbedrijf en Zaadhandel D. J. van der Have. 1879-1979. Review Stelpflug S C, Eichten S R, Hermanson P J, Springer N M, Kaeppler SM3 Consistent and heritable alterations of DNA methylation are induced by tissue culture in maize. Genetics. 2014 September; 198(1):209-18. doi: 10.1534/genetics.114.165480. Epub 2014 Jul. 14.

Sneep J, Hendrksen A J T (eds.) Holbeck O (coed.) (1979). Pudoc Center for Agricultural Publishing and Documentation Wageningen.

Solovyev V, Kosarev P, Seledsov I, Vorobyev D (2006). Automatic annotation of eukaryotic genes, pseudogenes and promoters. Genome Biol. 7, Suppl. 1:10.1-10.12.

Szcześniak M W, Kabza M, Pokrzywa R, Gudyś A, Makatowska 1 (2013). ERISdb: a database of plant splice sites and splicing signals. Plant Cell Physiol. 2013 February; 54(2).

Thévenin L (1967a). Les problèmes d'amélioration chez *Asparagus officinalis* L.. I. Biologie et amélioration. Ann. Amélior. Plantes 17:33-66.

Thévenin L (1967). Contribution a l'étude de la sexualité et de l'haploidie chez l'asperge cultiveé (*Asparagus officinalis* L.) Thése presentée à la Faculté des Sciences de Montpellier pour obtenir la grade de Docteur Ingénieur. University de Montpellier Faculté des Sciences.

Untergasser A, Nijveen H, Rao X, Bisseling T, Geurts R, Leunissen J A M (2007). Primer3Plus, an enhanced web interface to Primer3. Nucleic Acids Res. 35 (Web Server issue): W71-W74.

Untergrasser A, Cutcutache I, Koressaar T, Ye J, Faircloth B C, Remm M, Rozen S G(2012)Primer3-new capabilities and interfaces. Nucleic Acids Research 40(15): e115

Vuylsteke M, Peleman J D, van Eijk M J (2007). AFLP-based transcript profiling (cDNA-AFLP) for genome-wide expression analysis. Nature protocols 2(6):1399-413.

Westergaard M (1958). The Mechanism of Sex Determination in Dioecious Flowering Plants. Advances in Genetics 9:217-281.

Wittwer C T, Reed G H, Gundry C N, Vandersteen J G, Pryor R J (2003). High-resolution genotyping by amplicon melting analysis using LCGreen. Clin. Chem. 49(6 Pt 1):853-60.

Wricke G (1967). Untersuchung zur Vererbung des Geslechts bei *Asparagus officinalis* L. Z. PL. Zücht. 60:201-211.

Wricke G (1973). Untersuchungen zur Vererbung des Geschlechts bei *Asparagus officinalis* L. II. Y-Chromosome-gebundene Unterschiede im Andromonoziegrad. Z. Pflanzenzucht September 1973, 70 (2) p. 91-98.

Yu Q, Tong E, Skelton R L, Bowers J E, Jones M R, Murray J E, Hou S, Guan P, Acob R A, Luo M C, Moore P H, Alam M, Paterson A H, Ming R. A physical map of the papaya genome with integrated genetic map and genome sequence. BMC Genomics. 2009 Aug. 7; 10:371. doi: 10.1186/1471-2164-10-371.

Zhang C, Hsieh T F. Heritable Epigenetic Variation and its Potential Applications for Crop Improvement. Plant Breeding and Biotechnology 2013; 1:307-319.

SEQUENCE LISTING (175 sequences)

SEQ ID NO: 1 - DNA, 2280 bp, Asparagus officinalis
  CDS (1)..(1227)
atgtctgaagcctgggtttctcgattgacatcggatatagggtggctcaatagcacaaatgccctgatggcggaggcctggagtcgtcattcaatctacgacgtaccagacacattcaaaaggattagcccacagatccataagccatcaacgtgcagcattggaccacggtacaatggagatctgaatctccttcgtatggaacgtcataaacacagggcgctactgaacttcctcatccgatgtcaagtgtcgatccatgacatcatacgagccctgaggaagaacctgcacgatttcagagcctgctatcaagatcttgacaccttttggatgaagaatgatgatgagttcctaaaaatcatgatttacgatggggctttcatgattgaaatcatgatagcgaccgttgaaccatatgagcgcacaccttctagctatcatgccaaggacccaatattcaagaagccatacttggtcgaagatcttcgtgtagatatgctcaggttggataatcaaattccaatgaaggtcctggagatattgtctaaattctgcaagaacaagatccaaagcattcatcagctgatcagacatttcttcttccgcaaatatgaagagggaagatatgatattagccaaacctctacgatatttcacctacccgagataacagggcatcacctactggatgtgtacaaaaaaactcttatacagcatggaggttatcatcacaccagcagtcgccaaccactatcggcagttgaactacaggaggcgggcgtaattttccagtgcagtgaaacgctgtcattgacagatatatgcttcaccaaaggtgtcctttgcctacctgcagtcgacgttgacgaagcatttgaagttgttatgcggaatctcattgcctatgagcaagcacatggcgaaggtcaagaggtaacatcctatgtgttttttatggatggcattgtaaacaatgacaaagatattgccttgcttcgagagaagggtattatcaggtcgggggtaagcagtgataagaggatagccgatctttttaatggactgacaaaaggtatagttgcaaaagttgtcgacaatgttgatgttgatgtaaccaaggacatcaatgagtattgcaatagaagatggaacaggtggcaagccaactttaagcagagatactttgcgaatccatgggcctttcccgggattcataaatgttgatctcaacggtagggtttcgtgctggggtttgagtatctgtggagcatttagtgtgagaaaactgtgcttaatttcgcttctccactatgagagtggaggagcacaactaatggtatccagtgtaaatttaactctttgtttgtggcttgagaacaacatgttctttatatagcctttgacaatgtaatagataacatcaacttctttgatacatactagcgatattagcatccaaaaaaaaaactacccgagataacagggcatcacctactggatgtgtacaaaaaaactcttatacagcatggaggttatcatcacaccagcagtcgccaaccactatcggcagttgaactacaggaggcgggcgtaattttccagtgcagtgaaacgctgtcattgacagatatatgcttcaccaaaggtgtcctttgcctacctgcagtcgacgttgacgaagcatttgaagttgttatgcggaatctcattgcctatgagcaagcacatggcgaaggtcaagaggtaacatcctatgtgttttttatggatggcattgtaaacaatgacaaagatattgccttgcttcgagagaagggtattatcaggtcgggggtaagcagtgataagaggatagccgatctttttaatggactgacaaaaggtatagttgcaaaagttgtcgacaatgttgatgttgatgtaaccaaggacatcaatgagtattgcaatagaagatggaacaggtggcaagccaactttaagcagagatactttgcgaatccatgggcctttcccgggattcataaatgttgatctcaacggtagggtttcgtgctggggtttgagtatctgtggagcatttagtgtgagaaaactgtgcttaatttcgcttctccactatgagagtggaggagcacaactaatggtatccagtgtaaatttaactctttgtttgtggcttgagaacaacatgttctttatatagcctttgacaatgtaatagataacatcaacttctttgatacatactagcgatattagcatccaaaaaaaaaa

SEQ ID NO: 2 - protein, 408 aa, Asparagus officinalis
MSEAWVSRLTSDIGWLNSTNALMAEAWSRHSIYDVPDTFKRISPQIHKPSTCSIGPRYNGDLNLLRMERHKHRALLNFLIRCQVSIHDIIRALRKNLHDFRACYQDLDTFWMKNDDEFLKIMIYDGAFMIEIMIATVEPYERTPSSYHAKDPIFKKPYLVEDLRVDMLRLDNQIPMKVLEILSKFCKNKIQSIHQLIRHFFFRKYEEGRYDISQTSTIFHLPEITGHHLLDVYKKTLIQHGGYHHTSSRQPLSAVELQEAGVIFQCSETLSLTDICFTKGVLCLPAVDVDEAFEVVMRNLIAYEQAHGEGQEVTSYVFFMDGIVNNDKDIALLREKGIIRSGVSSDKRIADLFNGLTKGIVAKVVDNVDVDVTKDINEYCNRRWNRWQANFKQRYFANPWAFPGIHKC

SEQ ID NO: 3 - DNA, 12641 bp, Asparagus officinalis
gggccaaccccggaccgggcccggactgacgggctttttggattggcctaaacatatgcatttatctttaaaagtccatgttatttttatgggcttgttgcaagcaagcatggcggtaaactaatcctgggtttcaacattagtgctagtaaagctttgccatcttttttttttttgctttaaagggccaaccccggaccgggcccggactgacgggctttttggattggcctaaacatatgcatttatctttaaaagtccatgttatttttatgggcttgttgcaagcaagcatggcggtaaactaatcctgggtttcaacattagtgctagtaaagctttgccatcttttttttttttgctttaaagtaattttttagtaaacttttattcttaatagttcacaacaacacgagaaccatacaagtgaaagaaattttatccccaaaaaatttcaaataaccatctccaattttcaccaaataatccatcacaattatctatattatacgcaattccactgttttctcgattttttaactttacaagtcattagattcctagcacacaaaattaccattgtttgtgggaggaaaaaaggcatattctacgcttacaacccaagtcacacgataatcacattcttcaagcttatgaggaaacttcgtcctattcccccaacttaaattattacaaaaaatcaggaataaggaaaaaagaaaaaatttccttctctaaaatttcaactaagaccattatcaacttcttccaaataatttgtacccatcatcagtttctaccgttctcactcatcgaaacataaattttacagtttctacaagaataaaataaacaagactgagtcatagagagaggagaagatggcagcgagatcggaggagaagatcttgtcgaactagtagggatgagctcaaggttggtggtgttggcactgggggatggggagagatagacgatgggattcgacggaaagatgaagagggagaggaggagggttaggagaaagtaggagaggaggttgaatcgaaagttgagaatgacgacgagctcgagaaaggagtagatggcagcgagtttgaaggagaagatcttgtcaaacaagttgagcatgagctcaaggtcggtagtggcgaagggcaaggcgacagagttagacggcagatgccaaggagaagatgaagagggagaggaggaggctaaggagagagtagaaagagatgaggctgaatcacaaatgggacgaaagttatgagatcgaagaggggtcttttcggaattctcaaacgacatttcttggggtagagtgaaaagagggctgaatcaaaaagatgcaatgtatttggggctaaaatacaagagggaaataatacggtggcttgagacacatcaaagtttaaattttagggccttcacacaactttcccaattttaaattcttgctctcctaaccaaacgcaaaacaaaagaaaaaaaaccgaaaaaaaaagaagagaaaaattaataacaggaagaggccgaaagaggcttttattttccatttcactggtgagggaggaagattaactgaacctcccctttataccctctagttattctagcgacacgaactcaactccaggtgacaacattcatagagacgataaacctcatcacctcatatgcaccttcacaacaattaccatctcctgacagcaaacccgccggtcccatatcagccctctgcattcgcctcccttcgagctcccttctcaaacctgtcttctccaagttccaagattcaccttcttgaacaagattcaagaacatgtctgaagcctgggtttctcgattgacatcggatatagggtggctcaatagcacaaatgccctgatggcggaggcctggagtcgtcattcaatctacgacgtaccagacacattcaaaaggattagcccacagatccataagccatcaacgtgcagcattggaccacggtacaatggagatctgaatctccttcgtatggaacgtcataaacacagggcgctactgaacttcctcatccgatgtcaagtgtcgatccatgacatcatacgagccctgaggaagaacctgcacgatttcagagcctgctatcaagatcttgacaccttttggatgaagaatgatgatgagttcctaaaaatcatgatttacgatggggctttcatgattgaaatcatgatagcgaccgttgaaccatatgagcgcacaccttctagctatcatgccaaggacccaatattcaagaagccatacttggtcgaagatcttcgtgtagatatgctcaggttggataatcaaattccaatgaaggtcctggagatattgtctaaattctgcaagaacaaggtaaggaatgttaatgaaatctaaatcttcataccttgaaatgtcccagctgtaactccagaagaacttgcacaaaattttcatacctcgtaatgcaagattaacctaacagtcaacgttgtatgaaatgatacattatgcaaggaggatactcgcacaaaatttgctatccattgaagatatcattcccatgagatttttttgcaaataaatgagtaatgtgcatgctcaagaaagcagtcaccatattgaaatcatgcagaagacactatttgcatatacatcatatatgctctattgaactaagacctggataaataacttctggatagataaactttattgaaatcctgcagaagacactatttgctgttaagtgttgaactttgtgtatggatccctttataaagctatcgtaatttatgctgttgcttaaagcaaataacttttttctgtcttccagatccaaagcattcatcagctgatcagacatttcttcttccgcaaatatgaagagggaagatatgatattagccaaacctctacgatatttcacctacccgagataacagggcatcacctactggatgtgtacaaaaaaactcttatacagcatggaggttatcatcacaccagcagtcgccaaccactatcggcagttgaactacaggaggcgggcgtaattttccagtgcagtgaaacgctgtcattgacagatatatgcttcaccaaaggtgtcctttgcctacctgcagtcgacgttgacgaagcatttgaagttgttatgcggaatctcattgcctatgagcaagcacatggcgaaggtcaagaggtaacatcctatgtgttttttatggatggcattgtaaacaatgacaaagatattgccttgcttcgagagaagggtattatcaggtcgggggtaagcagtgataagaggatagccgatctttttaatggactgacaaaaggtatagttgcaaaagttgtcgacaatgttgatgttgatgtaaccaaggacatcaatgagtattgcaatagaagatggaacaggtggcaagccaactttaagcagagatactttgcgaatccatgggtaacttgctcactcattgtaggagctctagtattaggtctcaccatcactcaaacaatctatggcatcctttcttataataagtgtagttaatgtaactctcatactcgaaaatgtatggatgattccagtcttgatcccagtcttttgtcatggctgtgtggctgtaagcattgtaatttgagacaatgacaaggatgaataggctaatatcaactgaaaaagcttcatattttttttggtttttgctcaagattgaataaaaatggctttaaaaaggtaatgtgtaacaatgtctcagattttattctttccacaccctgaactcaacttggttgcttctgtgcccaagtcaaatattaataaaaccatgtgcctttcttgcaagatcttggattttgttcgggtgccatttaataagagaagcttgaaggcatccctttgcattacccaaatggaatctgggagctatgttttaattacatttaaatagtggctctttgagggtgtttgtctttcaaatgttcagttccatgtcttacttccagttataattttttctagtgtagtgatactcttagtttctgctcatgatttaatgcatagtatctggcaaccaataaatgcaaatgcattagtgtcgatcacataacaagaaatgattagttcttcgagccaatttaattttctctgttattccttgatttccaaaactttgttattgttttgtcttatctgatctcagtctttctttgcaggcctttcccgggattcataaatgttgatctcaacggtagggtttcgtgctggggtttgagtatctgtggagcatttagtgtgagaaaactgtgcttaatttcgcttctccactatgagagtggaggagcacaactaatggtatccagtgtaaatttaactctttgtttgtggcttgagaacaacatgttctttatatagcctttgacaatgtaatagataacatcaacttctttgatacatactagcgatattagcatcctatctttttcttcttcatgttaacaatcctatagcctttacacgggtaatatatccttgtgatgtttaatcctaagtttttctctggtcagtgaatatgaacagcagctattattttattgcttgttctttgtagcccaaatacttttatggtaaaatgctcaccataattttgcagtaaatatccgattacctcattgtttctctattccacttagctacaatatagcttcattgtctggtgtacattcaaacaaattaaaacctgttttttcactcctaattgaggagtgaaaaagacaaggaagcccatatagttaattttctttaatgttgacagcaacctcaaccaccctcataatagatttcatgtttattcctcaaacttatacttcttgcatagttctattaatgtgtatgattacaatgaaatgttttgaaaccatctttttagtgtgagatttatgatgcatcatttgagatttaattatatttgcgatcgagaattatattagtctacttctcataatacatttactaaatcccttttgttacttggtgtgaatggagccattgaaccatgtgaatttatgcagctccttattgtctttctttttaatatttctgtaatgtacttgtgtatttacaacctttaagtatatttcagcattagctaattttttaagtagcattttcgcttttgtatcaattttctttttaacagaggtcataattgttgtgcttcattcaagttgatcaccaatatcactgtagggtatcaattctattgttggtcctaaaactgctaggaatatcgttgtctgacctgagcttgatttttgtttcttttactaattatttgtgtctttttagtaaacatgacacatgtttattatgtttttgttcatatgtcaccaatacagctgtagtgcatcaaatcagtttacacttacagtagttctcttcatttttgttctgatactgcagtttccgttgttgaagcaaagaaataactaataagacaaagcaagacagatgagtgcaatagttctaaaaattactgcacatgattttctaaaaaatgaagcattcacattacaacatttatttcctactgtaagttaactccataaatagaaagctgcaagtttcaggcataaattgtgaagggaaaatagcttgcttttccatggaaacaaggttcatatcttcttccatttcacatggttatgattcaaattgtttcctttagtagttttgcatgtgcaagtctgtgcttggtggttgtgtttctccaattcctgctcaaagtaattgtttgttataaatttattataaaattaatgtggaaattcatgaggtttatatgttgatagcttcatgagaaagactacggatgagtgagagacttgtacacttgtgcaaatttgttcatttatgcaaacttcatgtcattaattgtcaaagcgttttccattctggtatgtgtaaaacatgatataattgaaataaaaatctacattaccatcaaagcaaaattctttaaacaagcattccaaacgagaattaaaaaaaaaatactgaaatatgaccagtcaatgaggtcacaagactaacataagcttggcgtgaatagttgctgaggattctcaatatgcgaggcatttggaagcaccaaaatccgcaccctaccgagtacccaaatcaaacactttccatggtgcctttccactatcttcctcacaatgtaatcttctagtgaaataaatgcagttacctctgttgagagagtggatagccttctcatcaaagagctagcagtgttcacctacccccgtgctacaatgttcacctaccccctgctacagtgttcacctgtcccaaatagtgttcacctgcccccatgagaaaatttataaatatccccctaagtttgatttgtaaggtatctcagtagcagagagagaaagagaaagatacagatataagtgatatcattgagaggtcttgagagagagtttgtaagaattcttggagagtgtattgaacaagagagggtgttctcttttatctttatttttgtaacctcgaaaggaatataaaggaattgggcgtcgtcgttgcaccgtggagtagctccgtaagagtgaaccacgttatatctgtgagtactgtgattgaattcgtgtttattggttctattatgtgattctaagatcgtttgggtgtgttttgcgtctccatttgaggctttcttgttagcgtgtaccctaacaagtggtatcagagcatacggtttgggaaagacggaatcttttgctatgggatctacagttgaagataacatacttcggattgaaaagttcggcggccaaaattttaggtattagaggatgcagatgaaagactatttgtaccaaaaggatctcttcatacccctccaagtagaggcggggaaacctgagaagatggacgatgataagtggaaggtgctcgatcgtaaagcacttgctgttagttctcttgttttgatgatgatttacaaacatcattattggtgctaattgcttgttgagttatattgtgtagattataatttatcaagcaagttagtgttaatgttggaggattggatggaatcaagctcaacgatgatatccatggaggtggaggaaatgtgttgaagcaaagctttcaagagcacaatacataagagaagcttcatcaaaatatgagcaaatatcaagaccaaagaattgtattcatatagatatttgcatctttctctttctctcaagtgcttgatgtagacaagttattgagttgataacatttgaagctcattgggttcaacatacattttcacaaaaacattgtttttgaactattttgaaaaatgagcagttttactattggaaaatgatctttcagaaattcttgttctaacatgttcaaaatcatgtttataagcattttctaaagttttataatttttggaatttatttgatattttattttgattttacaaagtcagattttcaactaacattaaattcctgtatgtacatgttttcggtcgaccgggctttgcccgtcggtcgaccaactagagaagctgttttcatgaccctgcaaatagtcacttgcggtcaaccgatttacattgcgcggtcgatcgatgactaagggtcagtcaaccggaacatcattgtcggtcgaccgaaccagttccagattgctgagtctgcaacggtcaaatattcagtcgaccggacattatccatcgatcgaccggatcttctataatggctagtttttgtaccagttgattttcaggattttggtacttgtttggaatttgggctattgtttggggttcctatatataccccattgctctcttcacttcagtaatgattttagcaagagaaaaatcttaagtttagttttctaagtgttcttaagctcaaactttcaattcttaatcctcaattgtgtttaatcctttgtttttctcacatccacactccacaacccttgagctttacttgttcttcacttgatccttgtcataggattgttgtgagagtttttcattctttcattgtgattgtgtggtgagattgatctcgaggagatcactcgtgtggattgtaaaatcttaaaaggagatcattgtgaagaagttccggctttcaaaccgggtgtgatagtaaagttaccatcgggagaggtggtcgggacgtaggtcggaggatcgaacctcgtgaacttatcgtgtgtcactattggataactattctctaaactctttctttatttattgcctttgcatttaatttggttggtgtgttacattgacaaattttaattgcacatttattgtcacattaccctattcacccccttaaggtaatttcaattggtatcagagcaaggtctctacatatttattaggtctaacaccttagagaaaagatccaaatggattctacaatgaatgtgcatatgcttgaaggtcaatccaccactataccctctttgttcaccgacaataattttgcatattggaaagctaggatgagaatttacttacgatgcattgaacttgacatcctagaaataatagagaagaaatatgttgagaagtctagtaaagatatgaccaagcatgaaaggcatttggctaacctaaatgttaaaaccatgaacgctttgatttgtggtctcaccccaaatgagtacaatagggtctccatatgtgcaatcgcacataagatttgggagaaactatgtgttactcatgaaggaacccccaagtcaaagagttcaaaattagtagcctcatgcatgattatgagttatttaagatgcttcctaatgagtcaattgatgccatgttttctcgatttactaacattgttaatgaattgcatggccttgacaaggtgttggagaaccaagagaagaattataaaattctttactctttaacgccggcatgggagcctaaaactacggctatcgaggaagtcaatgatctcagaacatttacacttgatggtctcattggcaagctcaaggtctatgagaagaagatcaaggagaaggaggaagtgccctctcgagcaaatgaagagccttcccaaaagatgaaaacaattacgctcaaaggagcaattgatgattcctcctcctcggatagtgaagtagatgtctctaaagaagtggcacacctctctagaaggatatcaagattaataaagatgaataaaatttttaaaaatcattctaacaagttcccctctcgtgtaggtaaatgttttgagtgcaataaaccgggacacatagcaaaggattgtcccaagataaaagagaagtacatgaagtacaaaaagaagaaggcaatgtatgcgggatgggagaaatccgaaccaagcgactcggatagtgacgaagaagcctgataatcacattttattacaattttatacccttattatctattttatatgaataaatatgccattaataattgtttttatctttaattgcaggttagtaaagaataaaacccaagatctcttatcttaacaaaaacccataaattaaatgaagaacacaagcaagagtcaaaaagcccaagcccagaatcaagccgagtagcctgtagaagccggagaaaataaaaaaattaaatatgaaaaaaatatattcaagatagttggccgtaaagaaacgacgatatcttccaatccgaaaggcaaaatttaacatataatatatgaaaatcgcctatctcgacgagaccaagctaaccgtaaagtcaaaatttttattggagcatcgatgccagtatcgatgcgggcatcgatgcctgtatcgatgcgaagtcatccagatttcatcaacggccgaaattgcattcttggggctcaagtttgatccaagggctctcattcactgatgtttactataaataggggttgagagtgaggggttagaggtgtgaaaatttttgtaactctttttggagaggagggctacttttaattgagaaggccttccaaatttataactttttattacaattaataaaataattttttttaccactgtaaatttttctcttcttctctttgttggatgatgaagatgaagatgaagatggagattaatttgaaggtatgtttttcttatttctctttaattgcttattagtttagatttattttcatgcttgcaaatagattttattttcttgtttaaatagccaagaggctagaaccctcttgccttagatttatttcatgcttatagattagatttatttcatgcttatagagtagatttattttttttgcatttaattcttgtaatttattttgtagtttagattttgtaatttattttgtagttagattttaattttttatactattcaccttgaggctagaaccctcttggatttagtttttctttttattcatttttattttttttatttgcctttaggctagaaccctctagggaatcatatttttctaagaagtggattcaattctaggttacccatatctttaattgaatccgctatctttacattcttgatttttatttgttcttgatttttccttcttgccttgttgatcacatttacattatcacttccactctcaaatatattcatttacataatcattttcatctttccacaatcacattcacttatcactcctatttgtcacgcacacaacataagaaccgattttatattttctcctacaaaacaccttcctcgtggatcgatatctttatactataacttgacacggttgtgcacttgcaacatttttggtacatatttatgccgcatcaagtttttgacgtcattgccggggaaggtgcttaagtatgttttaattattttggttctttaacttgtgtgtttattgtgaaggaaacgcttgaagcttgaagatcgcggattggagaactaggatttgaagatttgcttgtaggtaattcttctttttagaatttttaattccaccctttagctacttcttcacaattagagacaattaggacttaaaaaaagagattttatttttgttgaccataataaaattcaccctccactttgacatttactaacaagataataaattcaaataatatcccccttctcatttgtttaattgttaaccctaattaaaaaaaaaggttttttcttttccatcctttttagttgcttttaattcattgggtttcatttcatattgttagtaggaattcaccaagtgatttgagcatcttgatttggcacacacttaaaaatatttttaagggtaaaacctaatattcaagataatgtgagagatttcatcacccttcccttagcctaaaaatcactaattcctcactacaccacccaagcctaataaaactcattagacgttggcccctaaggattcgagctcaataaggaacaagaaatccttaagtgaaccggtttaagttttctcagaatagttggtgtctaaggcaaggtttaggggttgcgtaaagcgctccgcaaggaaagaggtacttaattgatctttgatcaccctctagtactatccttacctggctaactacccgggtaaaactttaatcttttcactttaggagtttttggttaggaggtagtctagttgagttaagcttaaccctagagttagagtgattggaaagtgattgattttgatttgtttagttaggatttttttctctttttccattctctcctcattaaaaaaaactaacctttataataataaaaaaagtataaaaagaaatagttttggtgtatgcaaccgtggattagggataatacacatcgattaattcgctttgaaccaatcatagaaatagcgtatcctaatccacccgttcttcaagatatgtgctatcccattaggaatgcaatcccctcttgtattaggctccccgaaacaaatggaataaattttgagcttagagcgtattacataaatatgcttcccaaattccttggaaatgaaacagaagatgcatatatttttatcttggaatttgaggaagtgtgtattatgattaaaatgagagaattaacagaagatgcgatcaaactcagatttattccatttgctcttaaagacaaagtaaaaaaatggttgtatagcttacccgtaaattccatcactacttgggaggaatttatcaccgtttttcttaaaaaaaaaaattcctatccataaaacgataaagctaagaaacagcatcatgaattttaaaattatcctaggagaacctttttggaagtattttgaccgatttaaagatcttctcatctaatgtcctcatcacggtttagaaaaatggtgattgtgccaaataatttatgagggattagattattctacaaaaacttccttagaatcaatgtgccatggggattttatgaggaaaaataccgatgaagcttgggaatttctagagagtctatccgagaaaacaatgcaatgggaacactgtgataacatggttttatcagttccccattctaagtctaatggtctttccttggagtcaaacattacttctgaagc

SEQ ID NO: 4 - DNA, 831 bp, Asparagus officinalis
  CDS (1)..(831)
atgggcaggcctccatgctgcgataaatccaacgtgaagaagggactttggactgaggaagaagatttgaagctaatagcttataccaacactcatggaataggaaattggacttctgttccaaagaaagcagggttgaagagatgtgggaagagctgtaggctaagatggactaattatctgcgccctaatttgaagcatgagagcttcactcaacaagaagaggagatgattataacacttcatgctacaatcggaagccggtggtcggtaatcgcacatcacctcccgggtcgaacagacaacgacataaagaaccactggaacacaaaactgagcaaaaaactgtgccagcaaggcatcgaccccgtcacccacaaacccatctctcaaatcaaggaaaccatcaccactctagccgccgccgccgccgccaaccaccacctcctaatccaccctccacccttcaacacccgcgtcaacagctgcctgagccgcgacctcaagaacgtcctcctctccaaaccgcaacaattctacgaaccaacaacagccacaagcaccacattggatgaggtttataagcaggataaggagatcaaatggagcgattatctcgtcgacgatgttttcgtgccgaaccaagagaaggaattggtggtgaatggatatgggaaggagaaggtgacaagtgcagtggatgaggaggtgagtagtactgtgtttggaggtgaagggagtagtagctcgagttcttttgtggagggaatattagatcaggggagggagatgatgatggagttccctgagtttttttatgatttgctgtag

SEQ ID NO: 5 - protein, 276 aa, Asparagus officinalis
MGRPPCCDKSNVKKGLWTEEEDLKLIAYTNTHGIGNWTSVPKKAGLKRCGKSCRLRWTNYLRPNLKHESFTQQEEEMIITLHATIGSRWSVIAHHLPGRTDNDIKNHWNTKLSKKLCQQGIDPVTHKPISQIKETITTLAAAAAANHHLLIHPPPFNTRVNSCLSRDLKNVLLSKPQQFYEPTTATSTTLDEVYKQDKEIKWSDYLVDDVFVPNQEKELVVNGYGKEKVTSAVDEEVSSTVFGGEGSSSSSSFVEGILDQGREMMMEFPEFFYDLL

SEQ ID NO: 6 - DNA, 3392 bp, Asparagus officinalis
  misc_feature (490)..(502): n is a, c, g, or t
gaagctctagatgaacttcccaactgatctacacctccaaaaagcccaagcgttgcccgaagctctgagaccacttgttggggaaaccccttactatgccgagatccaaacaaccgccgagagaagataaacaaacataccaaatcaatagcacaaacaatcaacaccagttttaacgtggttcggcgagatgcctacgtccacggggcaaggaggggggagttttcactattagaaatcaagaggaacaaactagggttacaaatctctcataaaccctccacaaatcaactctcaatctctccaattgctcctagaatagaagccaaagaaaaaaaacccctttcagctctcaaactcctgcctatcaaaccctagaatcgtgttttgggtatttatagaaaacccaaacgaaacgggtctgaaacccagattctgcccaaaccgcttcggcggtcgaccgtgacggtcgaccgtgatgccatcgcgnnnnnnnnnnnnncgaccgcaccaactccagaagaaaacacggtcgaccgccacggtcgaccgccaaaggtccagacgcaccgtgagccttgtgcacgaacacggtcgaccaccaacctgtcgactgccatatgcctgatttctgccatttctaccgatatttttcatgataatcctctacccaacaatccaacaaatttgaacctgattggcacttgtgagccaagtaattgaggtgtgggtgcggtttgcagcccggaaaccacaaacttaatttaaaattttcacatcatatctcaaacattaaccgttttttgaacataaatcatgcatgccatcatttgataaatgagagtgaatctcatgcttttcttgcctatccttcttaaaaaagcttttaaatacatctacttctaactctgtgcataattggtttcatcatcattgtacctcagcccttaaggttaaatgtcgcatcaccatggcatctcttattctctcttttaccaaaaagaatttacattaacttatagcctaattataacttggtcattttttatattttatgatttgaaaagttttatgttaatattttgtagaattaggagatgggcaggcctccatgctgcgataaatccaacgtgaagaagggactttggactgaggaagaagatttgaagctaatagcttataccaacactcatggaataggaaattggacttctgttccaaagaaagcaggttctttttacgtagctaattggttgattttcttcaaaataatatttacgttattgattttttatttatttattggtaatgtgagtatgcaattttagggttgaagagatgtgggaagagctgtaggctaagatggactaattatctgcgccctaatttgaagcatgagagcttcactcaacaagaagaggagatgattataacacttcatgctacaatcggaagccggtattgttctctctatcaatttatttgattgaggattttatatcatgatgttaactactgtagttttcattttagtcaattaggaacattattttgtttgaatagttttaacctagaaagaatttctagtgtagagctgctaacacaaatatctttacactgtccagatattaaagcggggctgaaatagtaaaaaggaggaggaggaaaatatctataactatatatgacaaccccagtttgaaattgattttaaacataattttatctagaagtgagatggacaggcatcaaaaacctgtacttttgaaatgtagaatgtaaattaactcaacaataggatatttatacatttgaaattttcatatttgaaatcttctatgttgagttaatctatgattatcatctggggtccacagaaattgaaaacatttggttttggaacagaattctagtttcaaatgacagaaagatcttttataatctcaaaatgatgagtagttctattaattagtttttgcttactatttcagaagtttaccaaaagaccagtttgttttgttgaatttacatcaagatgagtagattgtctcttttgccagtttccctactcattttatcattcactaatgagtaatgagtagctaaattgtttaatattgcacaataggtataaactgctaatttcatgggtaaattacactaaacccccataaactttcagtgctttgtagtaaacacagtaaactttcaaaatcacactaaaatcccaataacttttgcagagaacttctatgaacttctatggtaaattatactaaaccctcatgaactttcaaaatacctttttatgttatttttttgttctaattttggggattatctacaaaactcagaaaaatcatgggcgctctttgcaattccaaaaagttcattggggtttagtgttattttgaaaattcattgggatatattgcaaaactctaaaagttcaagggtttattgtaatttaccctaatttaatattgcacattattgtccccttttgaatgaaatgggctaattaaggcttatatttcctttcgttatcatgagatttgaaagaactattggtgtaaaggaagctacggtagctaaaagtttggattagttaaagagtcatctaattaccttagaattaaagctaccggcatatttcaatttcgtgattggaggcagtatgaaagtgatgatccctatctcctaacaaatttaactaaccatgacgtacacacgatcactccccctcactctctccaacagtcacaattatattcctttttagtacttaattatgtacataacaccatgattatttttagtacaggtggtcggtaatcgcacatcacctcccgggtcgaacagacaacgacataaagaaccactggaacacaaaactgagcaaaaaactgtgccagcaaggcatcgaccccgtcacccacaaacccatctctcaaatcaaggaaaccatcaccactctagccgccgccgccgccgccaaccaccacctcctaatccaccctccacccttcaacacccgcgtcaacagctgcctgagccgcgacctcaagaacgtcctcctctccaaaccgcaacaattctacgaaccaacaacagccacaagcaccacattggatgaggtttataagcaggataaggagatcaaatggagcgattatctcgtcgacgatgttttcgtgccgaaccaagagaaggaattggtggtgaatggatatgggaaggagaaggtgacaagtgcagtggatgaggaggtgagtagtactgtgtttggaggtgaagggagtagtagctcgagttcttttgtggagggaatattagatcaggggagggagatgatgatggagttccctgagtttttttatgatttgctgtag

SEQ ID NO: 7 - DNA, 1743 bp, Asparagus officinalis
atgaaggtgttgtcatattccagcgtggttgagggtctgaggccacttgtgggtggcaatggctgggactactgcatcctgtggaaattgtctcaagatcagaggtttttggagtggatgggatgctgttgtagcggaacagaggcaagcattgcgaatggtggagggcttttctctggtgatgaaacatttcagaaatcaccatgcagggatttaatgctgcagcatccaagaacaagggcatgcgatgctctctcagagtttccttcttccatccccttggattcctctttaggcatttacgcacaagtattgatgtcgaaccagccaacttggcaaacacttcatgatgcggttggagcaaagactagggttcttgttcctattgctggtggactagttgagctactagtctcgaagcaagttgctgagaaccaacagatgacagacttcatcatgtcacaatgcaacgggagcatctacgaccatccaactgcgggtaatttccttgatgatcagagtttccagtgggaggcatccgcaggtggccaatcacaaccctacgcatctccgatgaacatcttcgaccagttgcagctcgatgcggctgcaacaatggacagcacggggtacgggcagcaggcagggctgacgagtgtgcatcagcaaaaggaatctgctccagcggagaaggaatcggtgaaacatgagggcggcagtgcgcgaggagattcggggacggaggggagtgaggatgatgaggaggggagggcggtagggaagaacgggaagcggcatcatgcaaagaatcttgtggcggagaggaagaggaggaagaagcttaatgatcggctctacgctctcagggccttggttcctaaaatcacaaagatggatagagcatcgattcttggagatgcgatagagtatgtgatggagttacagaagcaggtaaaagatctgcaggacgagctcgagaatgaatcaaatccagatgacaccgattcaaagcaaatcgaaagcaactatgacaatgtggaaacaggcaatcgaaatgggatgataaattataatctcatggagcttgaggagtcccttaacgctacaagtacgagaaatgctaagactgttgatcagtcgaacaatgaggagaaggggaatcaaatggagccacaagtggaggtgaagcagctggaagctaatgacttctacctcaaggttttttgtgagcataaggttggaggatttgcaaggctgatggaggcaatgagctcgcttgggctggaggtgaccaatgcaagtgtgactactcttcagtctttagtactgaatgttttcagggtgcagaagagggacaatgaaacgatgcaagtcgatcaagtcagggattcattgctggagctgactcgagggccaatccgagggtggccggagcctggacacactacagaaaaccgcggtggagattgccatcatgacaatggtctgcggcctaccgtggagatttggagaattttgattgtcgtgttgtgccaagctggcaacgttcctttgggttttggtttgtttggaaaaataatagattcgggaagtttgccgactgttgtgacgtatacgtttcttattaaagggctcctaaaagctcgaatgttgagcgaagcgattggtgtttgggatattatggtcattgcctccgttgccgtcgaccgccgcctcgccgccctcgacacgaagctatattga

SEQ ID NO: 8 - DNA, 985 bp, Asparagus officinalis
atgggaaggattccttgctgtgagaaggataatgtgaagagaggacagtggacccccgaggaggacaacaagctctcttcctacatcgcacaacacggcacccgaaactggcgtctcatccccaaaaatgccggccttcagagatgtgggaagagctgccggctacgatggaccaactacctccgcccggatctcaagcacggcgtattctcagactccgaagagcagaccatcgtcaagctccactccgtcgtcgggaacaggtggtcgttgatagcagggcaactgccagggcgaacagataacgatgtgaagaaccactggaacacgaagctgaagaagaagctgttgggcaagggtatcgacccggtgacccacaagcccttctcccatctcatggccgagattgctaccacggttcccccgctgcaagtagcccacctcgctgaagctgccctcggctgcttcaaggacgaaatgctgcacctccttaccaagaagcgggcggatttccctgcaaacggtactgatgtcggtgatggcacgggcttcccctatgcaatgagccccgtggaggacaaggaagagactgttcagaagatcaagctagggctctctcgagctatcatgcaggagcctggaaccgataagagctggggcttaatggagaacggagagccatcagatgggcttcctgttgtgtcaatgtgcgatgatgatttgtatcgaacgataggggatgagttcaggtacgagggaccatcgtatgcgaatggcgaggggtcagcatggagccagagcatgtgcacgggtagcacgtgcactgggggcggtggaacaccagactgtcatgtattgcacgagaaacacagtgacgacgagggggtggaggctgaaggcaagaggaggaaaatcgatgctgggcttttcggctctgatggtgttttatgggatttgtctgatgaccttatgatgaatcacatag

SEQ ID NO: 9 - DNA, 1911 bp, Asparagus officinalis
atggagaaggttcaatcttgctctagaaagaggaaaagaggagagaaggttttcagattcgagagcttctgtgcacctaggcaaccaatacttttcagtggctcgttccgagacaacgttaaggctcttcttgatttcggccatcaagaggatggagtgcacgaaggaatgcagttttggtcgtttcggctcgagcttcatcagtacccttcgactttcgtgaggatgttcgttgctgaggaggctgttgggctgtcgcagaatcgccagtgccttttttgccgattcgctggttgggggcaccacatgatctccaacaagagattccacttcgtgctgccattcaaaaaaactaaatcagaggtcgaaagcttgagcatagaacttggtagaaacagaccagggatatcgtcaatgggctcgaaattgatgggttcacaaggaaagcatctaatgcatggaatcatgcactctaatggctacggacatctcattactgtcaatggcattgaaggaggctctgatttcatctctggacatcaaatcatggacttgtgggataggatttgcactgctttgcatgtgagaaaagtgagtataacagattcagcaaagaagggaagcatggaactaaggctaattcatggactagtgtatggtcagccctggttcagtcgctgggactacaaactaagccatggaagctatggcgtcactccccaaatgtaccaaacctcgctcgaagccctacgaactctccccttatcaatcctcctccccaatttcgcctctatcattgccaagtaccaaaccctaagtgggctcaagttacaaaccatagccgacttaacctgcttcattacagagctgaatcgtcgattgcccccaaacaccccttcgacattcgactgtcgagaaatcatcagcgagccaacttgtcgttggtcgatgaaacgagttgagatggctgctcaagtcatagtcggggctctaaagaagtccaaatgtcgttgggtcacaagacaagaggtcagagatgccgccagagcctacattggtgacacaggcctactagactacgtgctcaagtctctcggcaaccacattgttggaaactatgttgttcgacggatggtcaacccgataaccaaaatacttgaatactgcttgcaggatgtatctactgttttccctagcttggatcatttcggttcacttcgttttcatgtcacaaggtctcagctcaagaaagacatgatgtacctctacaataacatatttggagcacatagcacattggctgccgatggggttttcagggcaatacttatcgctgctcgggtgattctcgacgccaaacaccttgttaaggattacaaggtgacaggtggctcgttacaagacacccaaatgaagaacaatgatcaatgtttaaaggtaatgtgcacgatacgaatcatgaacaatcaagagaagaaggaactgccaccatatgagatgttcacctttcagctcaatgcaacaattggggacctgaagagagagactgaaaaaaagttcagggaaatctatttgggcctgaagagcttcactgcagaatcagtggctggtcttaatgctgaagatactgatttcattgtaggagtacttgttgagcttggcaacaaagtgattgttgaaggaagagtagttaataatgctgatgagatttatgagggtggaaaagatgtggattgccattgcggagggaaggaggaggatggagaggtgatggtgtgctgcgatatctgtgggatttggcagcatgcaaggtgtgcagggattgaggacgaagaagaggatgttcctagggtttttctctgtaacctatgcgagaacaatatttccgcattgcctccaattcaatactag

SEQ ID NO: 10 - DNA, 847 bp, Asparagus officinalis
ctctctctctctctctctgcaatttacaagtacttcttctccgttgcttgttagcattatttgatagcaatgcctcgttggccaagagaccaagccaaggaatttgatgtgatgaacttcgcagactcaatgcttgatggctgctacggcgatggaggaggagaaggggagtttcggaaggagcagtccgcggctgcggcagagaagggagaggaaaggtacaagtcaaagaacctcgcagcagagaggaggaggaggagcaaactcaatcatcgactctttaccctcagatctttggttcctaacattactaagatgagcaaggagtcaaccctcattgatgcaatggattacatccacaacctccaaacacaaattagtgacctgaagcttgagatttcgaagatttgcgaagaagaggaccgcacgaagcaagggagcacatctagtacagagagcacagctcctccagagatggcccaataccagggaagggttgagctgaatcctatgggacaaaacaaattccatgttaagattatgtgcaacaagaggcctggagggtttattaaactgcttgatgccctctccagaaatggactagagattactgaaatcagctcctttgctttttcaggttttgatcagatagttttttgcattgaggcaacgggtgataaggagattcccatttctgagttaagaaagcttctaatggcgatagtcgaagtatctgaggagaataataaatgattaattttaaatcatgttcaattggtatttgtatgaatagattgatttagagtttgaacttcaaagttttctgtgcttttatttgctttagtaa

SEQ ID NO: 11 - DNA, 48 bp, Artificial Sequence
  marker targeting Mdh
cagctatagggacggtagaatttacygggttgctaatgatgtgaatga

SEQ ID NO: 12 - DNA, 101 bp, Artificial Sequence
  marker Asp276
gtagattcaagggagtacggcattggcgcgcagatattgcacgatcttggygttcggacaatgaagttgctgaccaacaacccggcaaaatatagcgggct

SEQ ID NO: 13 - DNA, 874 bp, Asparagus officinalis
ggctcttctggttgggatcagtcatcgactcagcaaactcagcaaactactcctgcaactggttatgattactacaaccagcagcagcagcagcagcagcagccaccaacatcagccccagctgataacaccagcgcctacaattattcccagcctcatcctggttatagctctcaaggttcttatactgctcagcagccaacttatggtcaggaaaactatgctgctcctggttataacactcaaactccccaaactggttatgatcaatcatacaattctgcacctgcttatgctggagctacctccaccaaccccactcaagatggatctgctgcatccaatcaaccaccaagcagtgctcctgctagttaccccccacaacctgtgtacggtgcacctgcaccattaacccaacccggttatggacagtctcctcaatcccagaagccaccggcaactccgccagcttatgctcaaacaggatatggtacaaatactggatatggtacacagtaccagcaggttcagccatatggtgggggcccaccagctggccagggagggtacggtcagcagcaagcatatggtgattcttacggcagtggtgggtattcccagccaccggcgtatgggagtgagggtggtgcagctccggcggctcctggtgcagtgaccaaggcttctcctcagagttagacgtgatgtatggtaagtttttgatgcggtagttttgctttaacacttagattccggtagaagtttagatgttgtagtcttgtgttttgctctgatttggttttgaatttagtaatggtttgttaagctttgttgtttctgcgtgggtggaaattctgtatgttttcaaatttga

SEQ ID NO: 14 - DNA, 510 bp, Asparagus officinalis
  misc_feature (45)..(45): n is a, c, g, or t
gagtcgacctgcgggcatgcaagcttggcgtgaatacgttgctgnggattctcaatatgcgaggcatttggaagcaccaaaatccgcaccctaccgagtacccaaatcaaacactttccatggtgcctttccactatcttcctcacaatgtaatcttctagtgaaataaatgcagttacctctgttgagagagtggatagccttctcatcaaagagctagcagtgttcacctacccccgtgctacaatgttcacctaccccctgctacagtgttcacctgtcccaaatagtgttcacctgcccccatgagaaaatttataaatatccccctaagtttgatttgtaaggtatctcattagcagagagagaaagagaaagatacagatataagtgatatcattgagaggtcttgagagagagtttgtaagaattcttggagagtatattgaacaagagaggggggtctcttttatctttatttttgtacctcgaaagggatataaaggaatt

SEQ ID NO: 15 - protein, 9 aa, Artificial Sequence
  endonuclease homing domain
LAGLIDADG

SEQ ID NO: 16 - DNA, 44 bp, Artificial Sequence
  oligo(dT) primer
  misc_feature (44)..(44): n is a, c, g, or t
gaccacgcgtatcgatgtcgacttttttttttttttttttttvn

SEQ ID NO: 17 - DNA, 24 bp, Artificial Sequence
  primer
aaattctgcaagaacaaggtaagg

SEQ ID NO: 18 - DNA, 24 bp, Artificial Sequence
  primer
tactgcaaaattatggtgagcatt

SEQ ID NO: 19 - DNA, 20 bp, Artificial Sequence
  primer
cttcgagctcccttctcaaa

SEQ ID NO: 20 - DNA, 20 bp, Artificial Sequence
  primer
tcaatcatgaaagccccatc

SEQ ID NO: 21 - DNA, 24 bp, Artificial Sequence
  primer
taaagctatcgtaatttatgctgt

SEQ ID NO: 22 - DNA, 20 bp, Artificial Sequence
  primer
tcaaatgcttcgtcaacgtc

SEQ ID NO: 23 - DNA, 20 bp, Artificial Sequence
  primer
atggcgaaggtcaagaggta

SEQ ID NO: 24 - DNA, 23 bp, Artificial Sequence
  primer
tgccatagattgtttgagtgatg

SEQ ID NO: 25 - DNA, 19 bp, Artificial Sequence
  primer
tagatgaatcccggccttg

SEQ ID NO: 26 - DNA, 20 bp, Artificial Sequence
  primer
ttgcaacaagcccataaaaa

SEQ ID NO: 27 - DNA, 20 bp, Artificial Sequence
  primer
cataagccatcaacgtgcag

SEQ ID NO: 28 - DNA, 20 bp, Artificial Sequence
  primer
agttgagttcagggtgtgga

SEQ ID NO: 29 - DNA, 23 bp, Artificial Sequence
  primer
aggttaatcttgcattacgaggt

SEQ ID NO: 30 - DNA, 20 bp, Artificial Sequence
  primer
gctccggcattatcaaagag

SEQ ID NO: 31 - DNA, 20 bp, Artificial Sequence
  primer
ccggcattatcaaagagagc

SEQ ID NO: 32 - DNA, 20 bp, Artificial Sequence
  primer
agcctgggtttctcgattga

SEQ ID NO: 33 - DNA, 20 bp, Artificial Sequence
  primer
cctcagggctcgtatgatgt

SEQ ID NO: 34 - DNA, 20 bp, Artificial Sequence
  primer
tcctcatccgatgtcaagtg

SEQ ID NO: 35 - DNA, 21 bp, Artificial Sequence
  primer
cgaccaagtatggcttcttga

SEQ ID NO: 36 - DNA, 20 bp, Artificial Sequence
  primer
atcatgccaaggacccaata

SEQ ID NO: 37 - DNA, 20 bp, Artificial Sequence
  primer
atgacagcgtttcactgcac

SEQ ID NO: 38 - DNA, 25 bp, Artificial Sequence
  primer
ctgtcattgacagatatatgcttca

SEQ ID NO: 39 - DNA, 24 bp, Artificial Sequence
  primer
tgcaactataccttttgtcagtcc

SEQ ID NO: 40 - DNA, 20 bp, Artificial Sequence
  primer
gtcgggggtaagcagtgata

SEQ ID NO: 41 - DNA, 19 bp, Artificial Sequence
  primer
agaaaacagtggaattgcg

SEQ ID NO: 42 - DNA, 16 bp, Artificial Sequence
  primer
atggcggaggcctgga

SEQ ID NO: 43 - DNA, 28 bp, Artificial Sequence
  primer
ttaactacacttattataagaaaggatg

SEQ ID NO: 44 - DNA, 30 bp, Artificial Sequence
  primer
gggcgggcaggttggataatcaaatttcaa

SEQ ID NO: 45 - DNA, 20 bp, Artificial Sequence
  primer
acagctgggacatttcaagg

SEQ ID NO: 46 - DNA, 24 bp, Artificial Sequence
  primer
ctcaggttggataatcaaattcca

SEQ ID NO: 47 - DNA, 21 bp, Artificial Sequence
  primer
agacaatatctccaggacctt

SEQ ID NO: 48 - DNA, 20 bp, Artificial Sequence
  primer
atgtctgaagcctgggtttc

SEQ ID NO: 49 - DNA, 20 bp, Artificial Sequence
  primer
ttacccatggattcgcaaag

SEQ ID NO: 50 - DNA, 20 bp, Artificial Sequence
  primer
tgttctcaagccacaaacaa

SEQ ID NO: 51 - DNA, 23 bp, Artificial Sequence
  primer
tctggcactaagaatcagttcct

SEQ ID NO: 52 - DNA, 20 bp, Artificial Sequence
  primer
gcgagtttccaacgaaatta

SEQ ID NO: 53 - DNA, 27 bp, Artificial Sequence
  primer
ttatacagcatggaggttatcatcaca

SEQ ID NO: 54 - DNA, 17 bp, Artificial Sequence
  primer
cgatagtggttggcgac

SEQ ID NO: 55 - DNA, 20 bp, Artificial Sequence
  primer
gcagttgttgatgcagagga

SEQ ID NO: 56 - DNA, 20 bp, Artificial Sequence
  primer
gaaacaatggagcaccacaa

SEQ ID NO: 57 - DNA, 24 bp, Artificial Sequence
  primer
tggatgaagaatgatgatgagttt

SEQ ID NO: 58 - DNA, 27 bp, Artificial Sequence
  primer
tttcattaacattccttaccttattct

SEQ ID NO: 59 - DNA, 20 bp, Artificial Sequence
  primer
gtgagcttagggcttatgtt

SEQ ID NO: 60 - DNA, 27 bp, Artificial Sequence
  primer
catcttctcataatgacccaaatattt

SEQ ID NO: 61 - DNA, 20 bp, Artificial Sequence
  primer
atggattcgactcggagact

SEQ ID NO: 62 - DNA, 20 bp, Artificial Sequence
  primer
tgagttgagagggtggagga

SEQ ID NO: 63 - DNA, 23 bp, Artificial Sequence
  primer
aggaaattttgcactcaaaggta

SEQ ID NO: 64 - DNA, 17 bp, Artificial Sequence
  primer
gcttctgttgcagtgca

SEQ ID NO: 65 - DNA, 20 bp, Artificial Sequence
  primer
gttgcagtgcagaagaccaa

SEQ ID NO: 66 - DNA, 20 bp, Artificial Sequence
  primer
gaacaggggcatttgacagt

SEQ ID NO: 67 - DNA, 20 bp, Artificial Sequence
  primer
ctcaaggggcttgtttgttc

SEQ ID NO: 68 - DNA, 20 bp, Artificial Sequence
  primer
cgtttatgggttggaccact

SEQ ID NO: 69 - DNA, 24 bp, Artificial Sequence
  primer
tgtgcttaatttcgcttctccact

SEQ ID NO: 70 - DNA, 21 bp, Artificial Sequence
  primer
gctggaattgattacttcgcc

SEQ ID NO: 71 - DNA, 19 bp, Artificial Sequence
  primer
gatgagagtcgcgagacac

SEQ ID NO: 72 - DNA, 20 bp, Artificial Sequence
  primer
ctcaaggggcttgtttgttc

SEQ ID NO: 73 - DNA, 20 bp, Artificial Sequence
  primer
gccacggcctagtttaagaa

SEQ ID NO: 74 - DNA, 20 bp, Artificial Sequence
  primer
tcatccaatgtggtgcttgt

SEQ ID NO: 75 - DNA, 20 bp, Artificial Sequence
  primer
ccatatccattcaccaccaa

SEQ ID NO: 76 - DNA, 19 bp, Artificial Sequence
  primer
accctccacccttcaacac

SEQ ID NO: 77 - DNA, 20 bp, Artificial Sequence
  primer
ccatatccattcaccaccaa

SEQ ID NO: 78 - DNA, 24 bp, Artificial Sequence
  primer
gtcctgcagataaattaagtgcgt

SEQ ID NO: 79 - DNA, 26 bp, Artificial Sequence
  primer
tcaggtctactaatactcaaacagct

SEQ ID NO: 80 - DNA, 19 bp, Artificial Sequence
  primer
ggtagttttgtagggccca

SEQ ID NO: 81 - DNA, 21 bp, Artificial Sequence
  primer
aaaaggcaccaaatttaaggc

SEQ ID NO: 82 - DNA, 23 bp, Artificial Sequence
  primer
gatgtccaccaaactttctagct

SEQ ID NO: 83 - DNA, 23 bp, Artificial Sequence
  primer
tggctgaataaaacttgtgtcaa

SEQ ID NO: 84 - DNA, 20 bp, Artificial Sequence
  primer
gcctcgaaagctcttcttct

SEQ ID NO: 85 - DNA, 23 bp, Artificial Sequence
  primer
tgcataagcagtaactccaaaca

SEQ ID NO: 86 - DNA, 28 bp, Artificial Sequence
  primer
attaagcctaactatcaaaatagtccaa

SEQ ID NO: 87 - DNA, 24 bp, Artificial Sequence
  primer
acctatcagctgagaaattcaatg

SEQ ID NO: 88 - DNA, 23 bp, Artificial Sequence
  marker
tctggcactaagaatcagttcct

SEQ ID NO: 89 - DNA, 20 bp, Artificial Sequence
  marker
gcgagtttccaacgaaatta

SEQ ID NO: 90 - DNA, 20 bp, Artificial Sequence
  marker
gcctcgaaagctcttcttct

SEQ ID NO: 91 - DNA, 23 bp, Artificial Sequence
  marker
tgcataagcagtaactccaaaca

SEQ ID NO: 92 - DNA, 20 bp, Artificial Sequence
  marker
gttgcagtgcagaagaccaa

SEQ ID NO: 93 - DNA, 20 bp, Artificial Sequence
  marker
gaacaggggcatttgacagt

SEQ ID NO: 94 - DNA, 567 bp, Asparagus officinalis
  CDS (1)..(567)
atgtctgaagcctgggtttctcgattgacatcggatatagggtggctcaatagcacaaatgccctgatggcggaggcctggagtcgtcattcaatctacgacgtaccagacacattcaaaaggattagcccacagatccataagccatcaacgtgcagcattggaccacggtacaatggagatctgaatctccttcgtatggaacgtcataaacacagggcgctactgaacttcctcatccgatgtcaagtgtcgatccatgacatcatacgagccctgaggaagaacctgcacgatttcagagcctgctatcaagatcttgacaccttttggatgaagaatgatgatgagttcctaaaaatcatgatttacgatggggctttcatgattgaaatcatgatagcgaccgttgaaccatatgagcgcacaccttctagctatcatgccaaggacccaatattcaagaagccatacttggtcgaagatcttcgtgtagatatgctcaggttggataatcaaattccaatgaaggtcctggagatattgtctaaattctgcaagaacaag

SEQ ID NO: 95 - protein, 189 aa, Asparagus officinalis
MSEAWVSRLTSDIGWLNSTNALMAEAWSRHSIYDVPDTFKRISPQIHKPSTCSIGPRYNGDLNLLRMERHKHRALLNFLIRCQVSIHDIIRALRKNLHDFRACYQDLDTFWMKNDDEFLKIMIYDGAFMIEIMIATVEPYERTPSSYHAKDPIFKKPYLVEDLRVDMLRLDNQIPMKVLEILSKFCKNK

SEQ ID NO: 96 - DNA, 593 bp, Asparagus officinalis
  CDS (1)..(591)
atccaaagcattcatcagctgatcagacatttcttcttccgcaaatatgaagagggaagatatgatattagccaaacctctacgatatttcacctacccgagataacagggcatcacctactggatgtgtacaaaaaaactcttatacagcatggaggttatcatcacaccagcagtcgccaaccactatcggcagttgaactacaggaggcgggcgtaattttccagtgcagtgaaacgctgtcattgacagatatatgcttcaccaaaggtgtcctttgcctacctgcagtcgacgttgacgaagcatttgaagttgttatgcggaatctcattgcctatgagcaagcacatggcgaaggtcaagaggtaacatcctatgtgttttttatggatggcattgtaaacaatgacaaagatattgccttgcttcgagagaagggtattatcaggtcgggggtaagcagtgataagaggatagccgatctttttaatggactgacaaaaggtatagttgcaaaagttgtcgacaatgttgatgttgatgtaaccaaggacatcaatgagtattgcaatagaagatggaacaggtg

SEQ ID NO: 97 - protein, 197 aa, Asparagus officinalis
IQSIHQLIRHFFFRKYEEGRYDISQTSTIFHLPEITGHHLLDVYKKTLIQHGGYHHTSSRQPLSAVELQEAGVIFQCSETLSLTDICFTKGVLCLPAVDVDEAFEVVMRNLIAYEQAHGEGQEVTSYVFFMDGIVNNDKDIALLREKGIIRSGVSSDKRIADLFNGLTKGIVAKVVDNVDVDVTKDINEYCNRRWNR

SEQ ID NO: 98 - DNA, 199 bp, Asparagus officinalis
  CDS (2)..(199)
gcctttcccgggattcataaatgttgatctcaacggtagggtttcgtgctggggtttgagtatctgtggagcatttagtgtgagaaaactgtgcttaatttcgcttctccactatgagagtggaggagcacaactaatggtatccagtgtaaatttaactctttgtttgtggcttgagaacaacatgttctttatatag

SEQ ID NO: 99 - protein, 65 aa, Asparagus officinalis
PFPGFINVDLNGRVSCWGLSICGAFSVRKLCLISLLHYESGGAQLMVSSVNLTLCLWLENNMFFI

SEQ ID NO: 100 - DNA, 567 bp, Asparagus officinalis; identical to SEQ ID NO: 94
  CDS (1)..(567)

SEQ ID NO: 101 - protein, 189 aa, Asparagus officinalis; identical to SEQ ID NO: 95

SEQ ID NO: 102 - DNA, 633 bp, Asparagus officinalis
  CDS (1)..(633)
atccaaagcattcatcagctgatcagacatttcttcttccgcaaatatgaagagggaagatatgatattagccaaacctctacgatatttcacctacccgagataacagggcatcacctactggatgtgtacaaaaaaactcttatacagcatggaggttatcatcacaccagcagtcgccaaccactatcggcagttgaactacaggaggcgggcgtaattttccagtgcagtgaaacgctgtcattgacagatatatgcttcaccaaaggtgtcctttgcctacctgcagtcgacgttgacgaagcatttgaagttgttatgcggaatctcattgcctatgagcaagcacatggcgaaggtcaagaggtaacatcctatgtgttttttatggatggcattgtaaacaatgacaaagatattgccttgcttcgagagaagggtattatcaggtcgggggtaagcagtgataagaggatagccgatctttttaatggactgacaaaaggtatagttgcaaaagttgtcgacaatgttgatgttgatgtaaccaaggacatcaatgagtattgcaatagaagatggaacaggtggcaagccaactttaagcagagatactttgcgaatccatgg

SEQ ID NO: 103 - protein, 211 aa, Asparagus officinalis
IQSIHQLIRHFFFRKYEEGRYDISQTSTIFHLPEITGHHLLDVYKKTLIQHGGYHHTSSRQPLSAVELQEAGVIFQCSETLSLTDICFTKGVLCLPAVDVDEAFEVVMRNLIAYEQAHGEGQEVTSYVFFMDGIVNNDKDIALLREKGIIRSGVSSDKRIADLFNGLTKGIVAKVVDNVDVDVTKDINEYCNRRWNRWQANFKQRYFANPW

SEQ ID NO: 104 - DNA, 27 bp, Asparagus officinalis
  CDS (1)..(27)
gcctttcccgggattcataaatgttga

SEQ ID NO: 105 - protein, 8 aa, Asparagus officinalis
AFPGIHKC

SEQ ID NO: 106 - DNA, 501 bp, Asparagus officinalis
  CDS (1)..(501)
atggcggaggcctggagtcgtcattcaatctacgacgtaccagacacattcaaaaggattagcccacagatccataagccatcaacgtgcagcattggaccacggtacaatggagatctgaatctccttcgtatggaacgtcataaacacagggcgctactgaacttcctcatccgatgtcaagtgtcgatccatgacatcatacgagccctgaggaagaacctgcacgatttcagagcctgctatcaagatcttgacaccttttggatgaagaatgatgatgagttcctaaaaatcatgatttacgatggggctttcatgattgaaatcatgatagcgaccgttgaaccatatgagcgcacaccttctagctatcatgccaaggacccaatattcaagaagccatacttggtcgaagatcttcgtgtagatatgctcaggttggataatcaaattccaatgaaggtcctggagatattgtctaaattctgcaagaacaag

SEQ ID NO: 107 - protein, 167 aa, Asparagus officinalis
MAEAWSRHSIYDVPDTFKRISPQIHKPSTCSIGPRYNGDLNLLRMERHKHRALLNFLIRCQVSIHDIIRALRKNLHDFRACYQDLDTFWMKNDDEFLKIMIYDGAFMIEIMIATVEPYERTPSSYHAKDPIFKKPYLVEDLRVDMLRLDNQIPMKVLEILSKFCKNK

SEQ ID NO: 108 - DNA, 706 bp, Asparagus officinalis
  CDS (1)..(705)
atccaaagcattcatcagctgatcagacatttcttcttccgcaaatatgaagagggaagatatgatattagccaaacctctacgatatttcacctacccgagataacagggcatcacctactggatgtgtacaaaaaaactcttatacagcatggaggttatcatcacaccagcagtcgccaaccactatcggcagttgaactacaggaggcgggcgtaattttccagtgcagtgaaacgctgtcattgacagatatatgcttcaccaaaggtgtcctttgcctacctgcagtcgacgttgacgaagcatttgaagttgttatgcggaatctcattgcctatgagcaagcacatggcgaaggtcaagaggtaacatcctatgtgttttttatggatggcattgtaaacaatgacaaagatattgccttgcttcgagagaagggtattatcaggtcgggggtaagcagtgataagaggatagccgatctttttaatggactgacaaaaggtatagttgcaaaagttgtcgacaatgttgatgttgatgtaaccaaggacatcaatgagtattgcaatagaagatggaacaggtggcaagccaactttaagcagagatactttgcgaatccatgggtaacttgctcactcattgtaggagctctagtattaggtctcaccatcactcaaacaatctatggcatccttt

SEQ ID NO: 109 - protein, 235 aa, Asparagus officinalis
IQSIHQLIRHFFFRKYEEGRYDISQTSTIFHLPEITGHHLLDVYKKTLIQHGGYHHTSSRQPLSAVELQEAGVIFQCSETLSLTDICFTKGVLCLPAVDVDEAFEVVMRNLIAYEQAHGEGQEVTSYVFFMDGIVNNDKDIALLREKGIIRSGVSSDKRIADLFNGLTKGIVAKVVDNVDVDVTKDINEYCNRRWNRWQANFKQRYFANPWVTCSLIVGALVLGLTITQTIYGIL

SEQ ID NO: 110 - DNA, 145 bp, Asparagus officinalis
  misc_feature: split-read consensus
tctgcaagaacaaggtaaggaatgttaatgaaatctaaatcttcataccttgaaatgtcccagctgtaactccagaagaacttgcacaaaattttccttattccttattccttattccttgcagttatatacgttatagcggatc

SEQ ID NO: 111 - DNA, 163 bp, Asparagus officinalis
  misc_feature (2)..(43): n is a, c, g, or t
tnnnnnnnnnnnnnnnnnnnnnnnnnnnnnnnnnnnnnnnnnnttatatacgttatagcggatcccatccatcggctccaaagcttcggccagctgtcgagcaagacgttgacgctgtctttgtcgtgctctctttgataatgccggagcgtcttcagaagtc

SEQ ID NO: 112 - DNA, 581 bp, Asparagus officinalis
ccttcgtatggacgtcataaacacagggcgctactgaacttcctcatccgatgtcaagtgtcgatccatgacatcatacgagccctgaggaagaacctgcacgatttcagagcctgctatcaagatcttgacaccttttggatgaagaatgatgatgagttcctaaaaatcatgatttacgatggggctttcatgattgaaatcatgatagcgaccgttgaaccatatgagcgcacaccttctagctatcatgccaaggacccaatattcaagaagccatacttggtcgaagatcttcgtgtagatatgctcaggttggataatcaaattccaatgaaggtcctggagatattgtctaaattctgcaagaacaaggtaaggaatgttaatgaaatctaaatcttcataccttgaaatgtcccagctgtaactccagaagaacttgcacaaaattttccttattccttattccttattccttgcagttatatacgttatagcggatcccatccatcggctccaaagcttcggccagctgtcgagcaagacgttgacgctgtctttgtcgtgctctctttgat

SEQ ID NO: 113 - DNA, 258 bp, Asparagus officinalis
tttggatgaagaatgatgatgagttcctaaaaatcatgatttacgatggggctttcatgattgaaatcatgatagcgaccgttgaaccatatgagcgcacaccttctagctatcatgccaaggacccaatattcaagaagccatacttggtcgaagatcttcgtgtagatatgctcaggttggataatcaaattccaatgaaggtcctggagatattgtctaaattctgcaagaacaaggtaaggaatgttaatgaaa

SEQ ID NO: 114 - DNA, 12 bp, Artificial Sequence
  HphI restriction site
  misc_feature (1)..(7): n is a, c, g, or t
nnnnnnntcacc

SEQ ID NO: 115 - DNA, 660 bp, Asparagus officinalis
gggtattatcaggtcgggggtaagcagtgataagaggatagccgatctttttaatggactgacaaaaggtatagttgcaaaagttgtcgacaatgttgatgttgatgtaaccaaggacatcaatgagtattgcaatagaagatggaacaggtggcaagccaactttaagcagagatactttgcgaatccatgggtaacttgctcactcattgtaggagctctagtattaggtctcaccatcactcaaacaatctatggcatcctttcttataataagtgtagttaatgtaactctcatactcgaaaatgtatggatgattccagtcttgatcccagtcttttgtcatggctgtgtggctgtaagcattgtaatttgagacaatgacaaggatgaataggctaatatcaactgaaaaagcttcatattttttttggtttttgctcaagattgaataaaaatggctttaaaaaggtaatgtgtaacaatgtctcagattttattctttccacaccctgaactcaacttggttgcttctgtgcccaagtcaaatattaataaaaccatgtgcctttcttgcaagatcttggattttgttcgggtgccatttaataagagaagcttgaaggcatccctttgcattacccaaatggaatctggga

SEQ ID NO: 116 - DNA, 1470 bp, Asparagus officinalis
  CDS (1)..(1227)
atgtctgaagcctgggtttctcgattgacatcggatatagggtggctcaatagcacaaatgccctgatggcggaggcctggagtcgtcattcaatctacgacgtaccagacacattcaaaaggattagcccacagatccataagccatcaacgtgcagcattggaccacggtacaatggagatctgaatctccttcgtatggaacgtcataaacacagggcgctactgaacttcctcatccgatgtcaagtgtcgatccatgacatcatacgagccctgaggaagaacctgcacgatttcagagcctgctatcaagatcttgacaccttttggatgaagaatgatgatgagttcctaaaaatcatgatttacgatggggctttcatgattgaaatcatgatagcgaccgttgaaccatatgagcgcacaccttctagctatcatgccaaggacccaatattcaagaagccatacttggtcgaagatcttcgtgtagatatgctcaggttggataatcaaattccaatgaaggtcctggagatattgtctaaattctgcaagaacaagatccaaagcattcatcagctgatcagacatttcttcttccgcaaatatgaagagggaagatatgatattagccaaacctctacgatatttcacctacccgagataacagggcatcacctactggatgtgtacaaaaaaactcttatacagcatggaggttatcatcacaccagcagtcgccaaccactatcggcagttgaactacaggaggcgggcgtaattttccagtgcagtgaaacgctgtcattgacagatatatgcttcaccaaaggtgtcctttgcctacctgcagtcgacgttgacgaagcatttgaagttgttatgcggaatctcattgcctatgagcaagcacatggcgaaggtcaagaggtaacatcctatgtgttttttatggatggcattgtaaacaatgacaaagatattgccttgcttcgagagaagggtattatcaggtcgggggtaagcagtgataagaggatagccgatctttttaatggactgacaaaaggtatagttgcaaaagttgtcgacaatgttgatgttgatgtaaccaaggacatcaatgagtattgcaatagaagatggaacaggtggcaagccaactttaagcagagatactttgcgaatccatgggcctttcccgggattcataaatgttgatctcaacggtagggtttcgtgctggggtttgagtatctgtggagcatttagtgtgagaaaactgtgcttaatttcgcttctccactatgagagtggaggagcacaactaatggtatccagtgtaaatttaactctttgtttgtggcttgagaacaacatgttctttatatagcctttgacaatgtaatagataacatcaacttctttgatacatactagcgatattagcatccaaaaaaaaaa

SEQ ID NO: 117 - protein, 408 aa, Asparagus officinalis; identical to SEQ ID NO: 2

SEQ ID NO: 118 - DNA, 1359 bp, Asparagus officinalis
  CDS (1)..(1359)
atgtctgaagcctgggtttctcgattgacatcggatatagggtggctcaatagcacaaatgccctgatggcggaggcctggagtcgtcattcaatctacgacgtaccagacacattcaaaaggattagcccacagatccataagccatcaacgtgcagcattggaccacggtacaatggagatctgaatctccttcgtatggaacgtcataaacacagggcgctactgaacttcctcatccgatgtcaagtgtcgatccatgacatcatacgagccctgaggaagaacctgcacgatttcagagcctgctatcaagatcttgacaccttttggatgaagaatgatgatgagttcctaaaaatcatgatttacgatggggctttcatgattgaaatcatgatagcgaccgttgaaccatatgagcgcacaccttctagctatcatgccaaggacccaatattcaagaagccatacttggtcgaagatcttcgtgtagatatgctcaggttggataatcaaattccaatgaaggtcctggagatattgtctaaattctgcaagaacaagatccaaagcattcatcagctgatcagacatttcttcttccgcaaatatgaagagggaagatatgatattagccaaacctctacgatatttcacctacccgagataacagggcatcacctactggatgtgtacaaaaaaactcttatacagcatggaggttatcatcacaccagcagtcgccaaccactatcggcagttgaactacaggaggcgggcgtaattttccagtgcagtgaaacgctgtcattgacagatatatgcttcaccaaaggtgtcctttgcctacctgcagtcgacgttgacgaagcatttgaagttgttatgcggaatctcattgcctatgagcaagcacatggcgaaggtcaagaggtaacatcctatgtgttttttatggatggcattgtaaacaatgacaaagatattgccttgcttcgagagaagggtattatcaggtcgggggtaagcagtgataagaggatagccgatctttttaatggactgacaaaaggtatagttgcaaaagttgtcgacaatgttgatgttgatgtaaccaaggacatcaatgagtattgcaatagaagatggaacaggtggcctttcccgggattcataaatgttgatctcaacggtagggtttcgtgctggggtttgagtatctgtggagcatttagtgtgagaaaactgtgcttaatttcgcttctccactatgagagtggaggagcacaactaatggtatccagtgtaaatttaactctttgtttgtggcttgagaacaacatgttctttatatag

SEQ ID NO: 119 - protein, 452 aa, Asparagus officinalis
MSEAWVSRLTSDIGWLNSTNALMAEAWSRHSIYDVPDTFKRISPQIHKPSTCSIGPRYNGDLNLLRMERHKHRALLNFLIRCQVSIHDIIRALRKNLHDFRACYQDLDTFWMKNDDEFLKIMIYDGAFMIEIMIATVEPYERTPSSYHAKDPIFKKPYLVEDLRVDMLRLDNQIPMKVLEILSKFCKNKIQSIHQLIRHFFFRKYEEGRYDISQTSTIFHLPEITGHHLLDVYKKTLIQHGGYHHTSSRQPLSAVELQEAGVIFQCSETLSLTDICFTKGVLCLPAVDVDEAFEVVMRNLIAYEQAHGEGQEVTSYVFFMDGIVNNDKDIALLREKGIIRSGVSSDKRIADLFNGLTKGIVAKVVDNVDVDVTKDINEYCNRRWNRWPFPGFINVDLNGRVSCWGLSICGAFSVRKLCLISLLHYESGGAQLMVSSVNLTLCLWLENNMFFI

SEQ ID NO: 120 - DNA, 1294 bp, Asparagus officinalis
  CDS (1)..(1293)
atgtctgaagcctgggtttctcgattgacatcggatatagggtggctcaatagcacaaatgccctgatggcggaggcctggagtcgtcattcaatctacgacgtaccagacacattcaaaaggattagcccacagatccataagccatcaacgtgcagcattggaccacggtacaatggagatctgaatctccttcgtatggaacgtcataaacacagggcgctactgaacttcctcatccgatgtcaagtgtcgatccatgacatcatacgagccctgaggaagaacctgcacgatttcagagcctgctatcaagatcttgacaccttttggatgaagaatgatgatgagttcctaaaaatcatgatttacgatggggctttcatgattgaaatcatgatagcgaccgttgaaccatatgagcgcacaccttctagctatcatgccaaggacccaatattcaagaagccatacttggtcgaagatcttcgtgtagatatgctcaggttggataatcaaattccaatgaaggtcctggagatattgtctaaattctgcaagaacaagatccaaagcattcatcagctgatcagacatttcttcttccgcaaatatgaagagggaagatatgatattagccaaacctctacgatatttcacctacccgagataacagggcatcacctactggatgtgtacaaaaaaactcttatacagcatggaggttatcatcacaccagcagtcgccaaccactatcggcagttgaactacaggaggcgggcgtaattttccagtgcagtgaaacgctgtcattgacagatatatgcttcaccaaaggtgtcctttgcctacctgcagtcgacgttgacgaagcatttgaagttgttatgcggaatctcattgcctatgagcaagcacatggcgaaggtcaagaggtaacatcctatgtgttttttatggatggcattgtaaacaatgacaaagatattgccttgcttcgagagaagggtattatcaggtcgggggtaagcagtgataagaggatagccgatctttttaatggactgacaaaaggtatagttgcaaaagttgtcgacaatgttgatgttgatgtaaccaaggacatcaatgagtattgcaatagaagatggaacaggtggcaagccaactttaagcagagatactttgcgaatccatgggtaacttgctcactcattgtaggagctctagtattaggtctcaccatcactcaaacaatctatggcatcctttcttataataagtgtagttaat

SEQ ID NO: 121 - protein, 430 aa, Asparagus officinalis
MSEAWVSRLTSDIGWLNSTNALMAEAWSRHSIYDVPDTFKRISPQIHKPSTCSIGPRYNGDLNLLRMERHKHRALLNFLIRCQVSIHDIIRALRKNLHDFRACYQDLDTFWMKNDDEFLKIMIYDGAFMIEIMIATVEPYERTPSSYHAKDPIFKKPYLVEDLRVDMLRLDNQIPMKVLEILSKFCKNKIQSIHQLIRHFFFRKYEEGRYDISQTSTIFHLPEITGHHLLDVYKKTLIQHGGYHHTSSRQPLSAVELQEAGVIFQCSETLSLTDICFTKGVLCLPAVDVDEAFEVVMRNLIAYEQAHGEGQEVTSYVFFMDGIVNNDKDIALLREKGIIRSGVSSDKRIADLFNGLTKGIVAKVVDNVDVDVTKDINEYCNRRWNRWQANFKQRYFANPWVTCSLIVGALVLGLTITQTIYGILSYNKCS

SEQ ID NO: 122 - DNA, 1389 bp, Asparagus officinalis
  CDS (1)..(1389)
atgtctgaaacctgggtttctcgattgatatcggatatagagtggctcaatagcagaaatgccctgatggcagacgcctggagtcgtcattccatctacaccgtcccggacacattcagaaggattagcccacagatccataagccttcaacgtgcagcatcggacctcggcactatggagatccgaatctccatcgtatggaatgtcataaacacagggccttacagaacttcctcgtccgatgtcgagtgtcgatccatgacatcatagaagccctgaacaagaacctgcacgacttcagagcctgctatcaagatcttgatacattttggatgaaaaatgatgatgagttcctaagaatcatgctttatgatggagcattcatgatcgaaataatgttagcgacctttgaaacatatgtgtgcgcaccttctagttatcacgcaaaggacccagtattcaaaaaaccatacttggttgaagatcttcgtgtagatatgctcaggttggataatcaaattccaatgaaggtcctggagatattgtctgaattctgcaaaaacaagattcaaagcattcaccagctaatcagacatttcttcttccacaaatatgaagagggaagatatgatattagccaaacctctaggatatttcacctaacggagataacagggcatcacctgctggatgtgtacaagaaaactcttatacagaatggaggttatcatcacaccaacagtcgccaaccactatcggcagttgaactacaggaggcgggcgtaattttccagtgcagtgaaacgccatcattaacagatataagcttcgccaaagctgtcctttgcctacctgcagtcgacgttgacaaagcatttgaagttgttatgcagaatctcattgcctatgagcaagcacatggcgaaggtcaagaggtaacatcctatgtgttttttatggatggcattgtaaacaatgacaaagatattgccttgcttcgagagaagggtattatcaggtcgggagtaagcagtgataagaggatagccgatctttttaatggactgacaaaaggtccagttgcaaaagttgtcgacaatgttgatgttgatgtaacccaggacatcaatgactattgcaatagaagatggaacaggtggcaagccaactttaagcagagatactttacgaatccatggggctaatatcaactgaaaaaggttcataaggcagaaggaaagttgttacgagagttgagggttacatttttatactctaacatgaccctccaagtgagcgcacactttcatgagctgaatctggacttttcttgtaaaatccactttagaaattcaaagtcagtaaaaattgaacctggcttactctag

SEQ ID NO: 123 - protein, 401 aa, Asparagus officinalis
MSETWVSRLISDIEWLNSRNALMADAWSRHSIYTVPDTFRRISPQIHKPSTCSIGPRHYGDPNLHRMECHKHRALQNFLVRCRVSIHDIIEALNKNLHDFRACYQDLDTFWMKNDDEFLRIMLYDGAFMIEIMLATFETYVCAPSSYHAKDPVFKKPYLVEDLRVDMLRLDNQIPMKVLEILSEFCKNKIQSIHQLIRHFFFHKYEEGRYDISQTSRIFHLTEITGHHLLDVYKKTLIQNGGYHHTNSRQPLSAVELQEAGVIFQCSETPSLTDISFAKAVLCLPAVDVDKAFEVVMQNLIAYEQAHGEGQEVTSYVFFMDGIVNNDKDIALLREKGIIRSGVSSDKRIADLFNGLTKGPVAKVVDNVDVDVTQDINDYCNRRWNRWQANFKQRYFTNPWG

SEQ ID NO: 124 - protein, 60 aa, Asparagus officinalis
YQLKKVHKAEGKLLRELRVTFLYSNMTLQVSAHFHELNLDFSCKIHFRNSKSVKIEPGLL

SEQ ID NO: 125 - DNA, 1266 bp, Asparagus officinalis
  CDS (1)..(1266)
atgtctgaaacctgggtttctcgattgatatcggatatagagtggctcaatagcagaaatgccctgatggcagacgcctggagtcgtcattccatctacaccgtcccggacacattcagaaggattagcccacagatccataagccttcaacgtgcagcatcggacctcggcactatggagatccgaatctccatcgtatggaatgtcataaacacagggccttacagaacttcctcgtccgatgtcgagtgtcgatccatgacatcatagaagccctgaacaagaacctgcacgacttcagagcctgctatcaagatcttgatacattttggatgaaaaatgatgatgagttcctaagaatcatgctttatgatggagcattcatgatcgaaataatgttagcgacctttgaaacatatgtgtgcgcaccttctagttatcacgcaaaggacccagtattcaaaaaaccatacttggttgaagatcttcgtgtagatatgctcaggttggataatcaaattccaatgaaggtcctggagatattgtctgaattctgcaaaaacaagattcaaagcattcaccagctaatcagacatttcttcttccacaaatatgaagagggaagatatgatattagccaaacctctaggatatttcacctaacggagataacagggcatcacctgctggatgtgtacaagaaaactcttatacagaatggaggttatcatcacaccaacagtcgccaaccactatcggcagttgaactacaggaggcgggcgtaattttccagtgcagtgaaacgccatcattaacagatataagcttcgccaaagctgtcctttgcctacctgcagtcgacgttgacaaagcatttgaagttgttatgcagaatctcattgcctatgagcaagcacatggcgaaggtcaagaggtaacatcctatgtgttttttatggatggcattgtaaacaatgacaaagatattgccttgcttcgagagaagggtattatcaggtcgggagtaagcagtgataagaggatagccgatctttttaatggactgacaaaaggtccagttgcaaaagttgtcgacaatgttgatgttgatgtaacccaggacatcaatgactattgcaatagaagatggaacaggtggcaagccaactttaagcagagatactttacgaatccatgggtaacttgctcactcattgtgggagctctagtattaggtctcaccattactcaatacagtatatga

SEQ ID NO: 126 - protein, 421 aa, Asparagus officinalis
MSETWVSRLISDIEWLNSRNALMADAWSRHSIYTVPDTFRRISPQIHKPSTCSIGPRHYGDPNLHRMECHKHRALQNFLVRCRVSIHDIIEALNKNLHDFRACYQDLDTFWMKNDDEFLRIMLYDGAFMIEIMLATFETYVCAPSSYHAKDPVFKKPYLVEDLRVDMLRLDNQIPMKVLEILSEFCKNKIQSIHQLIRHFFFHKYEEGRYDISQTSRIFHLTEITGHHLLDVYKKTLIQNGGYHHTNSRQPLSAVELQEAGVIFQCSETPSLTDISFAKAVLCLPAVDVDKAFEVVMQNLIAYEQAHGEGQEVTSYVFFMDGIVNNDKDIALLREKGIIRSGVSSDKRIADLFNGLTKGPVAKVVDNVDVDVTQDINDYCNRRWNRWQANFKQRYFTNPWVTCSLIVGALVLGLTITQYSI

SEQ ID NO: 127 - DNA, 1281 bp, Asparagus officinalis
  CDS (1)..(1281)
atgtctgaaacctgggtttctcgattgatatcggatatagagtggctcaatagcagaaatgccctgatggcagacgcctggagtcgtcattccatctacaccgtcccggacacattcagaaggattagcccacagatccataagccttcaacgtgcagcatcggacctcggcactatggagatccgaatctccatcgtatggaatgtcataaacacagggccttacagaacttcctcgtccgatgtcgagtgtcgatccatgacatcatagaagccctgaacaagaacctgcacgacttcagagcctgctatcaagatcttgatacattttggatgaaaaatgatgatgagttcctaagaatcatgctttatgatggagcattcatgatcgaaataatgttagcgacctttgaaacatatgtgtgcgcaccttctagttatcacgcaaaggacccagtattcaaaaaaccatacttggttgaagatcttcgtgtagatatgctcaggttggataatcaaattccaatgaaggtcctggagatattgtctgaattctgcaaaaacaagaagacactatttgctattcaaagcattcaccagctaatcagacatttcttcttccacaaatatgaagagggaagatatgatattagccaaacctctaggatatttcacctaacggagataacagggcatcacctgctggatgtgtacaagaaaactcttatacagaatggaggttatcatcacaccaacagtcgccaaccactatcggcagttgaactacaggaggcgggcgtaattttccagtgcagtgaaacgccatcattaacagatataagcttcgccaaagctgtcctttgcctacctgcagtcgacgttgacaaagcatttgaagttgttatgcagaatctcattgcctatgagcaagcacatggcgaaggtcaagaggtaacatcctatgtgttttttatggatggcattgtaaacaatgacaaagatattgccttgcttcgagagaagggtattatcaggtcgggagtaagcagtgataagaggatagccgatctttttaatggactgacaaaaggtccagttgcaaaagttgtcgacaatgttgatgttgatgtaacccaggacatcaatgactattgcaatagaagatggaacaggtggcaagccaactttaagcagagatactttacgaatccatgggtaacttgctcactcattgtgggagctctagtattaggtctcaccattactcaatacagtatatga

SEQ ID NO: 128 - protein, 426 aa, Asparagus officinalis
MSETWVSRLISDIEWLNSRNALMADAWSRHSIYTVPDTFRRISPQIHKPSTCSIGPRHYGDPNLHRMECHKHRALQNFLVRCRVSIHDIIEALNKNLHDFRACYQDLDTFWMKNDDEFLRIMLYDGAFMIEIMLATFETYVCAPSSYHAKDPVFKKPYLVEDLRVDMLRLDNQIPMKVLEILSEFCKNKKTLFAIQSIHQLIRHFFFHKYEEGRYDISQTSRIFHLTEITGHHLLDVYKKTLIQNGGYHHTNSRQPLSAVELQEAGVIFQCSETPSLTDISFAKAVLCLPAVDVDKAFEVVMQNLIAYEQAHGEGQEVTSYVFFMDGIVNNDKDIALLREKGIIRSGVSSDKRIADLFNGLTKGPVAKVVDNVDVDVTQDINDYCNRRWNRWQANFKQRYFTNPWVTCSLIVGALVLGLTITQYSI

SEQ ID NO: 129 - DNA, 154 bp, Asparagus officinalis
tgtaactccagaagaacttgcacaaaattttccttattccttattccttattccttgcagttatatacgttatagcggatcccatccatcggctccaaagcttcggccagctgtcgagcaagacgttgacgctgtctttgtcgtgctctctttg

SEQ ID NO: 130 - DNA, 155 bp, Asparagus officinalis
tgtaactccagaagaacttgcacaaaattttcatacctcgtaatgcaagattaacctaacagtcaacgttgtatgaaatgatacattatgcaaggaggatactcgcacaaaatttgctatccattgaagatatcattcccatgagatttttttgc

SEQ ID NO: 131 - DNA, 463 bp, Asparagus officinalis
gtaaggaatgttaatgaaatctaaatcttcataccttgaaatgtcccagctgtaactccagaagaacttgcacaaaattttcatacctcgtaatgcaagattaacctaacagtcaacgttgtatgaaatgatacattatgcaaggaggatactcgcacaaaatttgctatccattgaagatatcattcccatgagatttttttgcaaataaatgagtaatgtgcatgctcaagaaagcagtcaccatattgaaatcatgcagaagacactatttgcatatacatcatatatgctctattgaactaagacctggataaataacttctggatagataaactttattgaaatcctgcagaagacactatttgctgttaagtgttgaactttgtgtatggatccctttataaagctatcgtaatttatgctgttgcttaaagcaaataacttttttctgtcttccag

SEQ ID NO: 132 - DNA, 464 bp, Asparagus officinalis
  misc_feature (205)..(464): n is a, c, g, or t
gtaaggaatgttaatgaaatctaaatcttcataccttgaaatgtcccagctgtaactccagaagaacttgcacaaaattttccttattccttattccttattccttgcagttatatacgttatagcggatcccatccatcggctccaaagcttcggccagctgtcgagcaagacgttgacgctgtctttgtcrtgctctctttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 133 - DNA, 463 bp, Asparagus officinalis
gtaaggaatgttaatgaaatctaaatcttcataccttgaaatgtcccagctgtaactccagaagaacttgcacaaaattttcatacctcgtaatgcaagattaacctaacagtcaacgttgtatgaaatgatacattatgcaaggaggatactcgcacaaaatttgctatccattgaagatatcattcccatgagatttttttgcaaataaatgagtaatgtgcatgctcaagaaagcagtcaccatattgaaatcatgcagaagacactatttgcatatacatcatatatgctctattgaactaagacctgaataaataacttctggatagataaactttattgaaatcctgcagaagacactatttgctgttaagtgttgaactttgtgtatggatccctttataaagctatcgtaatttatgctgttgcttaaagcaaataacttttttctgtcttccag

SEQ ID NO: 134 - DNA, 464 bp, Asparagus officinalis
gtaaggaatgttaatgaaatctaaatcttcataccttgaaatgtcccagctgtaactccagaagaacttgcacaaaattttcatacctcgtaatgcaagattaacctaacagtcaacgttgtatgaaatgatacattatgcaaggaggatactcgcacaaaatttgctatccattgaagatatcattcccatgagatttttttgcaaataaatgagtaatgtgcatgctcaagaaagcagtcaccatattgaaatcatgcagaagacactatttgcatatacatcatatatgctctattgaactaagacctggataaataacttctggatagataaactttattgaaatcctgcagaagacactatttgctgttaagtgttgaactttgtgtatggatccctttataaagctatcgtaatttatgctgttgcttaaagcaaataactttttttctgtcttccag

SEQ ID NO: 135 - RNA, 1359 nt, Asparagus officinalis
augucugaagccuggguuucucgauugacaucggauauaggguggcucaauagcacaaaugcccugauggcggaggccuggagucgucauucaaucuacgacguaccagacacauucaaaaggauuagcccacagauccauaagccaucaacgugcagcauuggaccacgguacaauggagaucugaaucuccuucguauggaacgucauaaacacagggcgcuacugaacuuccucauccgaugucaagugucgauccaugacaucauacgagcccugaggaagaaccugcacgauuucagagccugcuaucaagaucuugacaccuuuuggaugaagaaugaugaugaguuccuaaaaaucaugauuuacgauggggcuuucaugauugaaaucaugauagcgaccguugaaccauaugagcgcacaccuucuagcuaucaugccaaggacccaauauucaagaagccauacuuggucgaagaucuucguguagauaugcucagguuggauaaucaaauuccaaugaagguccuggagauauugucuaaauucugcaagaacaagauccaaagcauucaucagcugaucagacauuucuucuuccgcaaauaugaagagggaagauaugauauuagccaaaccucuacgauauuucaccuacccgagauaacagggcaucaccuacuggauguguacaaaaaaacucuuauacagcauggagguuaucaucacaccagcagucgccaaccacuaucggcaguugaacuacaggaggcgggcguaauuuuccagugcagugaaacgcugucauugacagauauaugcuucaccaaagguguccuuugccuaccugcagucgacguugacgaagcauuugaaguuguuaugcggaaucucauugccuaugagcaagcacauggcgaaggucaagagguaacauccuauguguuuuuuauggauggcauuguaaacaaugacaaagauauugccuugcuucgagagaaggguauuaucaggucggggguaagcagugauaagaggauagccgaucuuuuuaauggacugacaaaagguauaguugcaaaaguugucgacaauguugauguugauguaaccaaggacaucaaugaguauugcaauagaagauggaacagguggccuuucccgggauucauaaauguugaucucaacgguaggguuucgugcugggguuugaguaucuguggagcauuuagugugagaaaacugugcuuaauuucgcuucuccacuaugagaguggaggagcacaacuaaugguauccaguguaaauuuaacucuuuguuuguggcuugagaacaacauguucuuuauauag

SEQ ID NO: 136 - RNA, 1227 nt, Asparagus officinalis
augucugaagccuggguuucucgauugacaucggauauaggguggcucaauagcacaaaugcccugauggcggaggccuggagucgucauucaaucuacgacguaccagacacauucaaaaggauuagcccacagauccauaagccaucaacgugcagcauuggaccacgguacaauggagaucugaaucuccuucguauggaacgucauaaacacagggcgcuacugaacuuccucauccgaugucaagugucgauccaugacaucauacgagcccugaggaagaaccugcacgauuucagagccugcuaucaagaucuugacaccuuuuggaugaagaaugaugaugaguuccuaaaaaucaugauuuacgauggggcuuucaugauugaaaucaugauagcgaccguugaaccauaugagcgcacaccuucuagcuaucaugccaaggacccaauauucaagaagccauacuuggucgaagaucuucguguagauaugcucagguuggauaaucaaauuccaaugaagguccuggagauauugucuaaauucugcaagaacaagauccaaagcauucaucagcugaucagacauuucuucuuccgcaaauaugaagagggaagauaugauauuagccaaaccucuacgauauuucaccuacccgagauaacagggcaucaccuacuggauguguacaaaaaaacucuuauacagcauggagguuaucaucacaccagcagucgccaaccacuaucggcaguugaacuacaggaggcgggcguaauuuuccagugcagugaaacgcugucauugacagauauaugcuucaccaaagguguccuuugccuaccugcagucgacguugacgaagcauuugaaguuguuaugcggaaucucauugccuaugagcaagcacauggcgaaggucaagagguaacauccuauguguuuuuuauggauggcauuguaaacaaugacaaagauauugccuugcuucgagagaaggguauuaucaggucggggguaagcagugauaagaggauagccgaucuuuuuaauggacugacaaaagguauaguugcaaaaguugucgacaauguugauguugauguaaccaaggacaucaaugaguauugcaauagaagauggaacagguggcaagccaacuuuaagcagagauacuuugcgaauccaugggccuuucccgggauucauaaauguuga

SEQ ID NO: 137 - DNA, 94405 bp, Asparagus officinalis
  misc_feature (22174)..(22191): n is a, c, g, or t
  misc_feature (28714)..(28714): n is a, c, g, or t
  misc_feature (29197)..(29197): n is a, c, g, or t
  misc_feature (59069)..(59069): n is a, c, g, or t
  misc_feature (68914)..(70985): n is a, c, g, or t
  misc_feature (75424)..(75424): n is a, c, g, or t
  misc_feature (77348)..(77348): n is a, c, g, or t
  misc_feature (79068)..(79068): n is a, c, g, or t
  misc_feature (83923)..(84296): n is a, c, g, or t
  misc_feature (92904)..(92904): n is a, c, g, or t
gaggaaacttcgtcctattcccccaacttaaattattacaaaaaatcaggaataaggaaaaaagaaaaaatttccttctctaaaatttcaactaagaccattatcaacttcttccaaataatttgtacccatcatcagtttctaccgttctcactcatcgaaacataaattttacagtttctacaagaataaaataaacaagactgagtcatagagagaggagaagatggcagcgagatcggaggagaagatcttgtcgaactagtagggatgagctcaaggttggtggtgttggcactgggggatggggagagatagacgatgggattcgacggaaagatgaagagggagaggaggagggttaggagaaagtaggagaggaggttgaatcgaaagttgagaatgacgacgagctcgagaaaggagtagatggcagcgagtttgaaggagaagatcttgtcaaacaagttgagcatgagctcaaggtcggtagtggcgaagggcaaggcgacagagttagacggcagatgccaaggagaagatgaagagggagaggaggaggctaaggagagagtagaaagagatgaggctgaatcacaaatgggacgaaagttatgagatcgaagaggggtcttttcggaattctcaaacgacatttcttggggtagagtgaaaagagggctgaatcaaaaagatgcaatgtatttggggctaaaatacaagagggaaataatacggtggcttgagacacatcaaagtttaaattttagggccttcacacaactttcccaattttaaattcttgctctcctaaccaaacgcaaaacaaaagaaaaaaaaccgaaaaaaaaagaagagaaaaattaataacaggaagaggccgaaagaggcttttattttccatttcactggtgagggaggaagattaactgaacctcccctttataccctctagttattctagcgacacgaactcaactccaggtgacaacattcatagagacgataaacctcatcacctcatatgcaccttcacaacaattaccatctcctgacagcaaacccgccggtcccatatcagccctctgcattcgcctcccttcgagctcccttctcaaacctgtcttctccaagttccaagattcaccttcttgaacaagattcaagaacatgtctgaagcctgggtttctcgattgacatcggatatagggtggctcaatagcacaaatgccctgatggcggaggcctggagtcgtcattcaatctacgacgtaccagacacattcaaaaggattagcccacagatccataagccatcaacgtgcagcattggaccacggtacaatggagatctgaatctccttcgtatggaacgtcataaacacagggcgctactgaacttcctcatccgatgtcaagtgtcgatccatgacatcatacgagccctgaggaagaacctgcacgatttcagagcctgctatcaagatcttgacaccttttggatgaagaatgatgatgagttcctaaaaatcatgatttacgatggggctttcatgattgaaatcatgatagcgaccgttgaaccatatgagcgcacaccttctagctatcatgccaaggacccaatattcaagaagccatacttggtcgaagatcttcgtgtagatatgctcaggttggataatcaaattccaatgaaggtcctggagatattgtctaaattctgcaagaacaaggtaaggaatgttaatgaaatctaaatcttcataccttgaaatgtcccagctgtaactccagaagaacttgcacaaaattttcatacctcgtaatgcaagattaacctaacagtcaacgttgtatgaaatgatacattatgcaaggaggatactcgcacaaaatttgctatccattgaagatatcattcccatgagatttttttgcaaataaatgagtaatgtgcatgctcaagaaagcagtcaccatattgaaatcatgcagaagacactatttgcatatacatcatatatgctctattgaactaagacctggataaataacttctggatagataaactttattgaaatcctgcagaagacactatttgctgttaagtgttgaactttgtgtatggatccctttataaagctatcgtaatttatgctgttgcttaaagcaaataacttttttctgtcttccagatccaaagcattcatcagctgatcagacatttcttcttccgcaaatatgaagagggaagatatgatattagccaaacctctacgatatttcacctacccgagataacagggcatcacctactggatgtgtacaaaaaaactcttatacagcatggaggttatcatcacaccagcagtcgccaaccactatcggcagttgaactacaggaggcgggcgtaattttccagtgcagtgaaacgctgtcattgacagatatatgcttcaccaaaggtgtcctttgcctacctgcagtcgacgttgacgaagcatttgaagttgttatgcggaatctcattgcctatgagcaagcacatggcgaaggtcaagaggtaacatcctatgtgttttttatggatggcattgtaaacaatgacaaagatattgccttgcttcgagagaagggtattatcaggtcgggggtaagcagtgataagaggatagccgatctttttaatggactgacaaaaggtatagttgcaaaagttgtcgacaatgttgatgttgatgtaaccaaggacatcaatgagtattgcaatagaagatggaacaggtggcaagccaactttaagcagagatactttgcgaatccatgggtaacttgctcactcattgtaggagctctagtattaggtctcaccatcactcaaacaatctatggcatcctttcttataataagtgtagttaatgtaactctcatactcgaaaatgtatggatgattccagtcttgatcccagtcttttgtcatggctgtgtggctgtaagcattgtaatttgagacaatgacaaggatgaataggctaatatcaactgaaaaagcttcatattttttttggtttttgctcaagattgaataaaaatggctttaaaaaggtaatgtgtaacaatgtctcagattttattctttccacaccctgaactcaacttggttgcttctgtgcccaagtcaaatattaataaaaccatgtgcctttcttgcaagatcttggattttgttcgggtgccatttaataagagaagcttgaaggcatccctttgcattacccaaatggaatctgggagctatgttttaattacatttaaatagtggctctttgagggtgtttgtctttcaaatgttcagttccatgtcttacttccagttataattttttctagtgtagtgatactcttagtttctgctcatgatttaatgcatagtatctggcaaccaataaatgcaaatgcattagtgtcgatcacataacaagaaatgattagttcttcgagccaatttaattttctctgttattccttgatttccaaaactttgttattgttttgtcttatctgatctcagtctttctttgcaggcctttcccgggattcataaatgttgatctcaacggtagggtttcgtgctggggtttgagtatctgtggagcatttagtgtgagaaaactgtgcttaatttcgcttctccactatgagagtggaggagcacaactaatggtatccagtgtaaatttaactctttgtttgtggcttgagaacaacatgttctttatatagcctttgacaatgtaatagataacatcaacttctttgatacatactagcgatattagcatcctatctttttcttcttcatgttaacaatcctatagcctttacacgggtaatatatccttgtgatgtttaatcctaagtttttctctggtcagtgaatatgaacagcagctattattttattgcttgttctttgtagcccaaatacttttatggtaaaatgctcaccataattttgcagtaaatatccgattacctcattgtttctctattccacttagctacaatatagcttcattgtctggtgtacattcaaacaaattaaaacctgttttttcactcctaattgaggagtgaaaaagacaaggaagcccatatagttaattttctttaatgttgacagcaacctcaaccaccctcataatagatttcatgtttattcctcaaacttatacttcttgcatagttctattaatgtgtatgattacaatgaaatgttttgaaaccatctttttagtgtgagatttatgatgcatcatttgagatttaattatatttgcgatcgagaattatattagtctacttctcataatacatttactaaatcccttttgttacttggtgtgaatggagccattgaaccatgtgaatttatgcagctccttattgtctttctttttaatatttctgtaatgtacttgtgtatttacaacctttaagtatatttcagcattagctaattttttaagtagcattttcgcttttgtatcaattttctttttaacagaggtcataattgttgtgcttcattcaagttgatcaccaatatcactgtagggtatcaattctattgttggtcctaaaactgctaggaatatcgttgtctgacctgagcttgatttttgtttcttttactaattatttgtgtctttttagtaaacatgacacatgtttattatgtttttgttcatatgtcaccaatacagctgtagtgcatcaaatcagtttacacttacagtagttctcttcatttttgttctgatactgcagtttccgttgttgaagcaaagaaataactaataagacaaagcaagacagatgagtgcaatagttctaaaaattactgcacatgattttctaaaaaatgaagcattcacattacaacatttatttcctactgtaagttaactccataaatagaaagctgcaagtttcaggcataaattgtgaagggaaaatagcttgcttttccatggaaacaaggttcatatcttcttccatttcacatggttatgattcaaattgtttcctttagtagttttgcatgtgcaagtctgtgcttggtggttgtgtttctccaattcctgctcaaagtaattgtttgttataaatttattataaaattaatgtggaaattcatgaggtttatatgttgatagcttcatgagaaagactacggatgagtgagagacttgtacacttgtgcaaatttgttcatttatgcaaacttcatgtcattaattgtcaaagcgttttccattctggtatgtgtaaaacatgatataattgaaataaaaatctacattaccatcaaagcaaaattctttaaacaagcattccaaacgagaattaaaaaaaaaatactgaaatatgaccagtcaatgaggtcacaagactaacataagcttggcgtgaatagttgctgaggattctcaatatgcgaggcatttggaagcaccaaaatccgcaccctaccgagtacccaaatcaaacactttccatggtgcctttccactatcttcctcacaatgtaatcttctagtgaaataaatgcagttacctctgttgagagagtggatagccttctcatcaaagagctagcagtgttcacctacccccgtgctacaatgttcacctaccccctgctacagtgttcacctgtcccaaatagtgttcacctgcccccatgagaaaatttataaatatccccctaagtttgatttgtaaggtatctcagtagcagagagagaaagagaaagatacagatataagtgatatcattgagaggtcttgagagagagtttgtaagaattcttggagagtgtattgaacaagagagggtgttctcttttatctttatttttgtaacctcgaaaggaatataaaggaattgggcgtcgtcgttgcaccgtggagtagctccgtaagagtgaaccacgttatatctgtgagtactgtgattgaattcgtgtttattggttctattatgtgattctaagatcgtttgggtgtgttttgcgtctccatttgaggctttcttgttagcgtgtaccctaacaagtggtatcagagcatacggtttgggaaagacggaatcttttgctatgggatctacagttgaagataacatacttcggattgaaaagttcggcggccaaaattttaggtattagaggatgcagatgaaagactatttgtaccaaaaggatctcttcatacccctccaagtagaggcggggaaacctgagaagatggacgatgataagtggaaggtgctcgatcgtaaagcacttgctgttagttctcttgttttgatgatgatttacaaacatcattattggtgctaattgcttgttgagttatattgtgtagattataatttatcaagcaagttagtgttaatgttggaggattggatggaatcaagctcaacgatgatatccatggaggtggaggaaatgtgttgaagcaaagctttcaagagcacaatacataagagaagcttcatcaaaatatgagcaaatatcaagaccaaagaattgtattcatatagatatttgcatctttctctttctctcaagtgcttgatgtagacaagttattgagttgataacatttgaagctcattgggttcaacatacattttcacaaaaacattgtttttgaactattttgaaaaatgagcagttttactattggaaaatgatctttcagaaattcttgttctaacatgttcaaaatcatgtttataagcattttctaaagttttataatttttggaatttatttgatattttattttgattttacaaagtcagattttcaactaacattaaattcctgtatgtacatgttttcggtcgaccgggctttgcccgtcggtcgaccaactagagaagctgttttcatgaccctgcaaatagtcacttgcggtcaaccgatttacattgcgcggtcgatcgatgactaagggtcagtcaaccggaacatcattgtcggtcgaccgaaccagttccagattgctgagtctgcaacggtcaaatattcagtcgaccggacattatccatcgatcgaccggatcttctataatggctagtttttgtaccagttgattttcaggattttggtacttgtttggaatttgggctattgtttggggttcctatatataccccattgctctcttcacttcagtaatgattttagcaagagaaaaatcttaagtttagttttctaagtgttcttaagctcaaactttcaattcttaatcctcaattgtgtttaatcctttgtttttctcacatccacactccacaacccttgagctttacttgttcttcacttgatccttgtcataggattgttgtgagagtttttcattctttcattgtgattgtgtggtgagattgatctcgaggagatcactcgtgtggattgtaaaatcttaaaaggagatcattgtgaagaagttccggctttcaaaccgggtgtgatagtaaagttaccatcgggagaggtggtcgggacgtaggtcggaggatcgaacctcgtgaacttatcgtgtgtcactattggataactattctctaaactctttctttatttattgcctttgcatttaatttggttggtgtgttacattgacaaattttaattgcacatttattgtcacattaccctattcacccccttaaggtaatttcaattggtatcagagcaaggtctctacatatttattaggtctaacaccttagagaaaagatccaaatggattctacaatgaatgtgcatatgcttgaaggtcaatccaccactataccctctttgttcaccgacaataattttgcatattggaaagctaggatgagaatttacttacgatgcattgaacttgacatcctagaaataatagagaagaaatatgttgagaagtctagtaaagatatgaccaagcatgaaaggcatttggctaacctaaatgttaaaaccatgaacgctttgatttgtggtctcaccccaaatgagtacaatagggtctccatatgtgcaatcgcacataagatttgggagaaactatgtgttactcatgaaggaacccccaagtcaaagagttcaaaattagtagcctcatgcatgattatgagttatttaagatgcttcctaatgagtcaattgatgccatgttttctcgatttactaacattgttaatgaattgcatggccttgacaaggtgttggagaaccaagagaagaattataaaattctttactctttaacgccggcatgggagcctaaaactacggctatcgaggaagtcaatgatctcagaacatttacacttgatggtctcattggcaagctcaaggtctatgagaagaagatcaaggagaaggaggaagtgccctctcgagcaaatgaagagccttcccaaaagatgaaaacaattacgctcaaaggagcaattgatgattcctcctcctcggatagtgaagtagatgtctctaaagaagtggcacacctctctagaaggatatcaagattaataaagatgaataaaatttttaaaaatcattctaacaagttcccctctcgtgtaggtaaatgttttgagtgcaataaaccgggacacatagcaaaggattgtcccaagataaaagagaagtacatgaagtacaaaaagaagaaggcaatgtatgcgggatgggagaaatccgaaccaagcgactcggatagtgacgaagaagcctgataatcacattttattacaattttatacccttattatctattttatatgaataaatatgccattaataattgtttttatctttaattgcaggttagtaaagaataaaacccaagatctcttatcttaacaaaaacccataaattaaatgaagaacacaagcaagagtcaaaaagcccaagcccagaatcaagccgagtagcctgtagaagccggagaaaataaaaaaattaaatatgaaaaaaatatattcaagatagttggccgtaaagaaacgacgatatcttccaatccgaaaggcaaaatttaacatataatatatgaaaatcgcctatctcgacgagaccaagctaaccgtaaagtcaaaatttttattggagcatcgatgccagtatcgatgcgggcatcgatgcctgtatcgatgcgaagtcatccagatttcatcaacggccgaaattgcattcttggggctcaagtttgatccaagggctctcattcactgatgtttactataaataggggttgagagtgaggggttagaggtgtgaaaatttttgtaactctttttggagaggagggctacttttaattgagaaggccttccaaatttataactttttattacaattaataaaataattttttttaccactgtaaatttttctcttcttctctttgttggatgatgaagatgaagatgaagatggagattaatttgaaggtatgtttttcttatttctctttaattgcttattagtttagatttattttcatgcttgcaaatagattttattttcttgtttaaatagccaagaggctagaaccctcttgccttagatttatttcatgcttatagattagatttatttcatgcttatagagtagatttattttttttgcatttaattcttgtaatttattttgtagtttagattttgtaatttattttgtagttagattttaattttttatactattcaccttgaggctagaaccctcttggatttagtttttctttttattcatttttattttttttatttgcctttaggctagaaccctctagggaatcatatttttctaagaagtggattcaattctaggttacccatatctttaattgaatccgctatctttacattcttgatttttatttgttcttgatttttccttcttgccttgttgatcacatttacattatcacttccactctcaaatatattcatttacataatcattttcatctttccacaatcacattcacttatcactcctatttgtcacgcacacaacataagaaccgattttatattttctcctacaaaacaccttcctcgtggatcgatatctttatactataacttgacacggttgtgcacttgcaacatttttggtacatatttatgccgcatcaagtttttgacgtcattgccggggaaggtgcttaagtatgttttaattattttggttctttaacttgtgtgtttattgtgaaggaaacgcttgaagcttgaagatcgcggattggagaactaggatttgaagatttgcttgtaggtaattcttctttttagaatttttaattccaccctttagctacttcttcacaattagagacaattaggacttaaaaaaagagattttatttttgttgaccataataaaattcaccctccactttgacatttactaacaagataataaattcaaataatatcccccttctcatttgtttaattgttaaccctaattaaaaaaaaaggttttttcttttccatcctttttagttgcttttaattcattgggtttcatttcatattgttagtaggaattcaccaagtgatttgagcatcttgatttggcacacacttaaaaatatttttaagggtaaaaccccatattcaagataaggtgagggatttcatcacccttcccttagcccaaaaatcactaattcctcactacaccacccaagcctaataaaactcattagacgttggccctaaggattcgagctcaataaggaacaaagaatccttaagtgaaccggtttaagttttcttggattagttggtgtctaaggcaaggtttaggggttatgtaaaacgctccgcaaggaacgaggtacttaattgatctctgatcaccctctagtactatccttacctggctaactacccgggtaaaactttaatcttttcactttaggagtttttggttaggaggtagtctagttgagttaagcttaaccctagagttagagtgattggaaagtgattgattttgatttgtttagttaggatttttttctctttttccattctctcctcattaaaaaaaactaacctttataataataaaaaaagtataaaaagaaatagttttggtgtatgcaaccgtggattagggataatacacatcgattaattcgctttgaaccaatcatagaaatagcgtatcctaatccacccgttcttcaagatatgtgctatcccattaggaatgcaatcccctcttgtattaggctccccgaaacaaatggaataaattttgagcttagagcgtattacataaatatgcttcccaaattccttggaaatgaaacagaagatgcatatatttttatcttggaatttgaggaagtgtgtattatgattaaaatgagagaattaacagaagatgcgatcaaactcagatttattccatttgctcttaaagacaaagtaaaaaaatggttgtatagcttacccgtaaattccatcactacttgggaggaatttatcaccgtttttcttaaaaaaaaaaattcctatccataaaacgataaagctaagaaacagcatcatgaattttaaaattatcctaggagaacctttttggaagtattttgaccgatttaaagatcttctcatctaatgtcctcatcacggtttagaaaaatggtgattgtgccaaataatttatgagggattagattattctacaaaaacttccttagaatcaatgtgccatggggattttatgaggaaaaataccgatgaagcttgggaatttctagagagtctatccgagaaaacaatgcaatgggaacactgtgataacatggttttatcagttccccattctaagtctaatggtctttccttggagtcaaacattacttctgaagcgaagatgacgataattctgcggaggttagaagccttagaaattaaggaacaagctctagctcaaatcaatcatgtttctaccccaggatatcataattgtcagtctcctacccacgtttcagaggaatgtcctctcctaggaaataactatgcatgagaacagatgaacgttgtattccaacgccctagaaataatccattttctccaacctacaatccaggttgaagaaatcatcccaactttgcatagaatcaaggaaattctctcggaactcaaaacttcactcccgcttccacccaacattttcctagggaaaacacaaatccttttaattctcatccacaattttaacaacccaatctgtcgtatcaaaatcagtctcctcttcatcaagctgtaattcaggctcatcacaattcagatcaggataaccatctcaatgtcttggaaagaggtttggaaaccataattaaggcatccactcaaaccacgaatatgttgactcaaacgtctagcactctgaattccttcatgcaatcaactggacaaatgctcaactccaacactcaagctatagctaaattagaatcccaacttggtcaactaactagtgccgtgagtgaaagagagaaaggaaaattttcgagtcaacccgtggtaaaccctaaagacacaggatgcagttcatcctatgaagctcaagtgaatgcaatccattcacttcagtcaggtagacaggtagataatcaagtgagaactcctccaagtcaaacttttgatctaatataaattccttctccttctccttttgatgaatctattcaacaatcaccccccttagatgaccaagaacttgaacccgaacctgagcctatttttgatagatttagaccagttgctccctttctagatagactcaggcctaggaaatactctcctcaggaggagaaggtcctagaaacattcaagcaggttaaggtcaacatcttctcttagatgtaattgaacaaattccatcttatgctaaatttttaaaaaaaattatgcactaagaagaggagaataaatgttccaaagaaagtctttttagccgccaatatcagtgaaatactatcaaatcccatacctttgaaacgtaaagatccaggttcccccatcatttcatgtatcattgataatactcacattgataaggcgctgttagacttaagggccagtgttaatttgcttccatattcagtctaccagcaattgggtctatgtgtactgaacccaaccagatacaccttacagttggctgatagatctgttaaggtacccatgggtgagttagaggatgttctgattaaggttggagattttatttttccagtagattttgtagtcttggaaacacagcctgtttctaatcccaaaggacagacacctgtcatcttaggatgacttttcttagccacttctaatgctctcatcaactgtagaactggtcaaataaagctgtcctttgggaatttgactgctgatcttaacatttttaatccaggggaccagccaaataatcagcctctagaaataaattatattcaggaaagatcaaaagaagaagaagaagagtctgatttaagttttgaggaaatttttgatgaagagtttgagtttttagaagaagcagatcaggtccttgagaataatgaaactgtgttaaacatttgctgcttggaattaaattttgaagaactctttcttgatgaacttagattcttggagaaaaatcaacaactaaattttcagaactctacagaagaattggttgttagaaaataaaacttcacagtacaagagtctaagttcattaaaaaatacaaaatgcatgacaccaataatacctaccttactttgttgcaagaattattgaacaccccgaaatgtttggaatttcacattattgattatatcattctgaatttatttaaaattcgggaaagaattttcaacaataaggtaggattcaaggtagaatacgagctcttcgtgttgaacacttcattctacattattttttttgtttatttcagaataataaaaagaatttattcttctctcatttgagagtttcttgttcagttgtaaaaaaaacagaaaaaagaaaaaaagaagagaataataattttttgtttctatcctcctcagatcaaagataattgtagatttttatcagctaatcaaatgtaagtacttcacttcttatctgctttactttgtgcatcatggagtttgcattgaggataatgtaaaatttagatgtgggggtgagaattagttatttttttctctttattttacatttttagttgcatttttgtcattttttccttttccttaaaaaaatttataaaaatatcgtcacttgccaaattgatagagttatgtaataattgatttatttgataaattttaaattttctaatctctagtttgttatttactcaagtttaccttttatgataactctaaataaatttcttaagaaataattttcaaagtagaatacttcacttaagtcttaacttagatttttatttaaaataatggaatttatgcatgcttagcttagagtcaaaaataaattttcaaagtgtcttgacttacatatttttcagaatatatatacatatacataaaaatataacaaaagaagagtgcgaaaaatagacaccaaaagaaaaaaactcttaaattcaaggtgattctatcttataaagcctaagttgaccgagtaattaatcccaaggagtatttccatacgtaatgatctaagcctaaatgggttgggatccattggcctaaaactcgttaaatggtcgcttagaaaacccgttaaagtagaaaaaatcaccaaggaagaaagagttaaaaaataataataatataaaaatatatataaaaaaaataaaaatactaataaatattttagttatatttgtatatatgatcttggaaaatattttagatcaagcaaattgaatattattttaaacaaagagttagcatgttcttttcaaaacttttaagttaaatttctaagtttggcttggttttgtattgctataatgagaagattttctaggaaatttacctttaagttatttataaaaactttttcttgagtgataactagcttcaattagattgtctaaagttatcaagtgaatttagttatttactgacttctttaatttggcaagtagaccgaattttgtgggtatattcactgcaaaccctcatgagactataactcgtctactagggtaacctaggggtttaaaggcttgttgtatgcgctgaatacaaccgcgattcctgcaaaaagtgagttaggtcttctttcatttttctttctttgctagaggactagcaaaagtttaggtgtggggtatttaataatcatattttattacatatttataccctcattatctattttatatgaataaatatgccattaataattgtttttatctttaattgcaggttagtgaagaataaagcccaagatctcttatctcaataaaaacccatgaattaaatgaagaacacaagcaagagtcaaaaagcccaagcccagaatcaagccgagtagcttgtagaatccggagaaaataaaaaaattaaatatgaaaaaaatgtattcaagatagttggccgcaaagaaatgactatatctcctaatccggaaggcggaatttaacatataatatatgaaaatcacctatctcgacgagacgaagccaaccgtgaagttaaaatttttattggagcatcgatgccagcattaatgcgggcatcgatgccagcatcgatgcgggcatcgatgcctgtatcgatgcgaagtcatccagatttcatcaacggccgaaattgcattcttggggatcaagtttgatccaatggctctcattcactgatgtttactataaataggggttgagagtgaggggttagaggtgtgaaaatttttgtaactccttttggagaggagggctactcttaattgagaagaccttccaaatttataactttttattacaattaataaaataaattttttaccactttaaatttttctcttcttctctttgttggatgatgaagttaaagattgatacgggtgtatcttctcttcggaacttagcgatcctcatgagagcttgaggatagatgattctcatgataacatgagaatagaggtgtcaaacagtacaagggaacgcaggaggaagcgtgaaacgagacgatgagcagaagaatcgaagtatctagttttcagcctgtgagtcgactcataacagtcatgagtcaactcaccaggttgagtcgactcatgactgtcatgagtcgactcatcgctggtttttgagttttgtccagtttcggacgagtcgactcatctcagtcatgggtcgacacatcgatggtttcctggttcgtttgggtttctgttcacacaaattcctgttggttttgtgtctggttatttaccaaattgccatccacgtttgtacacctatataaatgattgttttagggtttctaaacaataagagaggtaattaagagagattctaatcattgtattagggtttagtgagaattgagagtttgttctcgattctagtgagattgtgagagagggattgtaatcttttcatactcataatctagagaaggtaattttcttcgccatatactgaattgtgcttgtgtttctgtcatcctcttctcaacccgcctttaataattccacaatcaaaggtgctcacacggcaactcgtatcaaggtggtatcagagcatcagatccggtgaaggggcatcctatgtatggtccttactcgatcccaatacaagaagcttggcgagatccttatttcattggaaggagtccatgttttaaggaagaagaagatggtcgaaggagacaattcaacgaggattgatgcattggagaagcagatcgagacgataggttcgactctcacacaactcgtcagtcttatccatggaggtggaaaacaaggtgaatcttcttcgaagaaaattgttgagtccgatgtggagagagtagattcagattccgatgaggaggaggagaccgttaagactgcattgcatcaagggggtaagatcttatcagaacctgaagattgacttcaaggtggagattcctgtttatgatgggagtgttaacgtcgagaggcttgatgactggatcgagcggatggagacgtattttactctttatggctattcgtcaaaagagaagattgtgttcgcgactttgaagctttccgggcacacgtttacgtggtgaaaatcctactgcaagcaggagaagaaggcggtgttgtggaacaagttcaatgagttactgagaaagcagttctacccagtgggattccttaaagaatgttggtacaagtggtacggcttacgccaaagggtcaatcaaaccgtttaagaatacaccacggagttccagcagcaggcgatggtcctcaacattgcgacagaggaatatttcgtgtttatgaagtaaatggcaggattgagcgattacatccgaaaggagatgaagttattcacagtcgagactattacagaggcgagcgtgaaggctattgccatcgagggcaagcaaaagaagggcaacgaggctaagggagactccaaacagacgggaggcgagtctagtggttctcaatctaaggaggagaagaagaagggtgatctagggaagacagggctgatttgtagtcactgcgagaagacagggcacacagctgatcggtgctgggagaagtatccccatctcaagccaagagggttgaagaagaaggaggagaaaaaagcatacatgatagctcaaggtccgaaaaaagtcccagggatgacagagcccaacaacagtctcaaccttatgatggagaagtagaccacgaaagaggacgacgacctgagagagcaactctttgttcttaagttgcaagtgaagaccagtttggttgatgccattgttgattcaggcagcgagaagaatttgatatccgaggcattggtgcagaagctgggtctgaagacagtcaagcatctgaagccctatctattggggtggattcagaaggaggagaaactgagtgtagttgatcaatgcactgtcagatttgcactccacgggtcgtatattgacgaggtcacgtatgacgtcgttccattggatgtttgtcagattatactaggtaatccgtacttatgggatagatatgcgatctacaagaggcgggctcagaagtacaccttcactaaggatggtgtaaagttcatatttcgttcggcatctcttctgaaggagacaagtttggggacggtagcgcgagcgaagagactaatgaatgcaagcaagaagtttgtctcgctgtgcattagacttctagaaaagccatcgacaaaggattgcaacttagagcgaacggtgactatgacgagacgcgggacgaatgagttgtttctgatcgaatgttgagaccggattcctagcaaggccaggtggtacagaaaagatggaggagctcgagagtttcctcagcaaaggttctaacttgaatgggacttcaagttcttaaagaggggacccatgatacgggtgtatcttctcttcggaacttagcgatcctcatgggagcttgaggatagatgattctcatgataacataagaatagaggtgtcaaacagtataaggaaacgcaggaggaagcgtggaacgagacgacgagcagaagaatcgaagtatccagttttcagcctgtgagtcgactcataacagtcatgagtcgactcatcaggttgagtcgactcatgactgtcatgagttaactcatcgctggtttttgagttttgtccagtttcggacgagtcgactcatctcagtcatgagtcgactcatcgatggtttcctggttcgtttgggtttctgttcacacgaattcctgttggttttatgtctggttatttaccaaattaccatccacgtttatatacctatataaaagattgttttagggtttctaaactataagagaggtaattaagagagattctaatcattgtattagggtttagtgagaattaagagtttgttctcgattctagtgagattgtgagagagagattataattttttcatactcataatctagagaaggtaatttccttcgccatatattgaattgtgcttgtgtttctgttatcctcttctcaacccacctttgataattccgcgatcaaagatgctcgcatggcaactcgtatcaaagatgaagatggagattaatttgaaggtttatttttcttatttctcttttattgcttattagtttagatttattttcatgcttgtaattagattttattttcttgtttaaatagccaataggctagaaccctcttgccttagatttatttcatacttatagattagatatatttcatgcttatagagtagatttttttttttatttaattcttgcaatttattttgtagtttagattttacaatttattttgtagttagattttaatttcttgcactattcaccttgaggctagaaccctcttgggtttagtttttctttttattcatttttattttttttgattcgcctttaggctagaaccctctagggaatcatatttttctaagaagtggattcaattctagattacccatatctttaattgaatccactatctttacattcttgatttttatttgttcttgatttttccttcttgccttgttgatcacatttatattatcacttccactctcaaatatattcatttacacaatcattttcatctctccataatcacattcacttatcactcctatttgtcttgcacacaacataagaactgattttatattttttcctacaaaacaccttcctcgtggatcgatatctttatactataacttgacacggttgtgcacttgcaacatttttggtacatatttatgccgcatcaaagccgccaagattgctctttatgatacaaatatatgcttcatggctcatgaagatgaggtacaatcctattccaataatgaatctttttatatgtaatgtgaacttggaacactagaagaattgaattttgaatttaaaaaattagcaaaagaacattcttcttttaaaaatttgcatgattcatgtgactcaaagtttaagcttttacaatcctcactaaatgatgttagtgctttacaagacaaaataattggagatcttgaatttgaaaataaacatttaaggtctcaaattgaaagattaaaaattaaagataaaactaattatgcttcttctagtaatactcatcaccaccttagaagaacatagcatcatagatctcatacccctacttataagaaagattttgtttgcacatattgcatgagacatggccacacgtctacacattgtagatttagagataatgcttattattatgggttgatgtgggtacctaagggtgccaagtgtactaatatccaaggaccaaagatttgtgtatctaaagcttctacctcttgtttacatgtagggaacatctcgtacaagacgtagagagttgtggtgccttaatagtggttactctcatcacataacgggtgataatgacttatttgtaactctatcaaggatagaaggaggcaatgtctcctttggtgacggtgagaaaggtaaaattgtgggtaatggtaatattggtaagatatattatcccgtgattaaggatgtttatttggtaaaaggacttaatcataatctcttaagtattagtcaacttagtgacaaaggctatgatgttatttttaaaccggataagtgtattgtaagtctaaaagataaagcaatttttgttgcccttagaaagtctaatgtatatatatttgagatgaatgagcttttagatcaagatgtgaagtgtcttgtcacggtggatggagatccttggatttggtgcaaaagacttggtcatgctcacatgaggttaatctctaagctatcaaagaagaacttggtaagaggactaccaagtctaacatgcattaaagattctcaatgtgaggaatgtaccaaaggtaaacaaatcaaaaactcttttaaatctataaatgaggtatccaccactaaacctttacaattgcttcatcttgatttatttagtcttatgcgtgttgcctcattaggaggaaagcattatgtgtttgttattgttgatgatttttcacgctttacatgggttatatttcttgctaataaagatgaatgttttgaaaaattctctcatttagtaaaaagaattgaaaataaaaaggatttgaaagttgtaaaaattagtgtaggctgtcaaaaaatcacaatagatagctgatcctcataaaaacaccgatgatggaagttacaatctgacgacttccagaaggctacaatttgaagactttcacgtagatcgctgaaggttacaatctgacgaccttcacgacaaccgatgagagctctagtttaacagcattcacaacatcaagagttacaatctgacgactcttgtatatcaaagagctaaagtaaagattataaaatgacgatctttgcaaaacttcgatagaaagagactacaaattgacggtctcttcaaatcaagacgtgaaagtcctccccgcgtaccagcatcaagatgcgccgcattcatagccacgaacgcagctcaaatgcagctccaaaagttgcaaacgcagttccaaaagttacaaacgcagctcagattcggccgccaacgcagcttccaaattgctataaacgcagccttcaaacgccgtaaacgcaggtcacatccagctccaaacgcagctcagatccgttgccaaacgcagctcttaaatcgtacaaacgcagttttcaaattgctgtaaacgcagctcagatccgctgccaaacacagctcttaaatcgctgcaaatgagcttccaaacgctgcgtccgagcttccagatgctgcgttcaagcttttaggcattgcgtttggacacagaattcatgccagaacacgggcctgcgtttgactcgnnnnnnnnnnnnnnnnnnttcattctcttctcttttgtaatcaggaaatccaattgtaatcgagattaaaggaatacaaatcaattttcctttgtttcttttactgcaaattttccacaaacaaaagatggcgactccgctggggaaactagcttctctgacgaagaagtggtggtgcaatccgatgttcatctcactggaaccacggttgaaactctagtcatagagttcgatcaagccaagtatgaggaagccctctcctccggatcccttagccccaaggctatgcgcaagatccacaaagtctccaaagagactaaagctccaactgctctaattgcagccgaaccgcctaaggaagactgttcggacagcccctcccccgatggagtgggcttagcttcagccaaacctgtgccaagacgacaggtatccggtcgaaagatgctcattgaggcgacaaacttgatcaacacagatggtgacgtcgctacaaaggccttgaagtgggctaagaagaatgctgctcgacgcaggaggagatccctacgacgagcacatctccgagaatgtcgatccttaagtcaacacgagcttcgtgtttgtgagcctaaacacgaccctatgccctgcgtttctgtttcagaatgcaagtctcgcgtctatgagcccaaacataggctctgtgtgaagaagactgagcgcaaccctcaggggcgcgttccacaaaatgaacgcaaccctcaggggtgcgttccacaaaataaacgcaactctcaaatatgcgtttcatcagcaaaacctgaagctcaggcatgcgttcagttgatgaaatccaatacagagcctggtatatatcgtgacccccggctcgctgatgaaacgcaattagatcgaggggcggatataagaagttcatggatccaaggcatctaaactagattcatgttcaccaagagccagtcctacccaatcatagactgggggttccaattcaaacctcacaatcagtgagtaattctcttcgaatctttacaatagatttgagagagttcatatcaagagaaagaccgatgcaacaagtcattcgttcattccaatgtgaacgactgattcctacagtcctctcgggatgtcaatgttgttcatttgcggccaaacaattggtgttcgaccaattaatgcatgttgccttgcccaaccaacaacgacgttctcacaggaagaagtctccagagaccgaatatcccgaggtcactatcaatgtgatcggcagagggaaaacctcaggtcctagttccaatgactctgagacaaggcgttcactgaccgtcagagaaatcacagacgagtttgaaggagtttatcaacatactcagactcgaacgggagccattccccctgtcaactatcggaggttagccacaggaactaatttcgatgatgaacattcagccattgctgagtcttaatcatcaagctctttcattgggcatgagagcttcacccacatggcagaacattctgaagatctttcaaagagggttgctgagcaagacgccatgctcaaatcacagcagaagactctcaatgaactcctagacctgttgactcaactcgtcgcagacaaggctaaatctcagaagacagagttgccacctaggcaagaatcctcccggagaggaaaaacgtcttcatcccgacttcacacaagtaaagggaaggggaaaataggcttgggctgggcttgcgggtgcggaaaaaccaaaatctctctctaaagctctttcgaaaaagtgttttcagtggttgatgacacggcttctgactaagaagcccacaacttagaatcttcctctgatgaaggaagagagacggagaacgagcagaatctccaatctgccaaaatggaagaattggaagcccgcctcaatgccattgttgacagaagtgagctccaagacgatggagttgccaggccctatcctgccgaataggatacagccccttatcctcccaagtttgaggtcccgacgatacaaacttttgacggtacgggttcaccgaaccaacatatctatcacttcaagtcacagactgggaatataatatcaaacgacgtcatactggctcgattgttcattggcaccctcaagggagttgcctttgaatggttcaggaaactgcctgctcgatgtatccaaaagtgggcggatctagaaagactcttcctgtcgagattctttgaagaggatacggaagtctccatccatacccttctcgccactaagcagaagaagagggagtccgtcaaagccttcgtcaagaggttccgaaccatggctctccggtgttcgtcaggtatgacacaatctaccctagtggagacctgtcagcacaatttgcaaaccgacctcctagcccgaatcggagttgcagaatgtcgttcttggagacaactaatctctcaaggcgaacaggctcaaaagattattgtcaggatcaaagctgaagaacaaagtaggcaggatcaacctgagcaatcggaccaagcccaatcttctcagtcagaagaagataccacgactattgaagctaatcctcttcagtaggatggcaggtccaacaactatcacgttaataattacctctgatagtcaacctcattagatagtggcccattaggcgatgtgccatgtctacccttttccccctgcacttgttcaagactgggggttggtttatttgtagttcattcgattatgaccaataaatttttttgagttgtcatgttcaatagaacacctccgtcaaccacaaaatccaccaaaactatcacgttaaccgtcacctctgatagttcatttcttccaaattcccccaccaatcctcttcaagtaggatggcgggtccatcataactatcacgttaacaattacctctgatagttcatttcttccatattcccccaccaatcctcttcaagtaggatggcgggtccaccaaaactatcacgttaaccgtcacatctgatagtccttttcctccaaattcccccaccaatcctcttcaagtaggatggcgggtccaccataactatcacgttaacaattaactctgatagttcatttcttccaaatttccccaccaatcctcttcaagtaggatgacgggtccaccaaaactatcacgttaaccgtcacctctaatagtcattttcctctaaattcccccaccaatcctcttcaagtaggatggcgggtccaccaaaactatcacgttaaccatcacctctgatagtccttttcctccaaattcccccaccaatcctcttcaagtaggatggcgggtccacaaaactatcacgttaacagttacctctgatagtcaaactcatcagataatggcctaccaggtgatgtgcctctgttccgacttcatggatagtgtcccactacgtgatgtgccttatctacttcttcttattcccctgctaagtcttaatcaagactggaggttggttacttggaatccactggattaagagtaacgaatcttttacatcgtcaagttaacattacacttctgacgatcatcatccccacagagtatgcattcaacttgcatcactcccaatttgtcacgttaacaatatacctctgacaacaatcaacttatcaatccttgacaataggattatgagtcctcaaaattgctcaaatcgcaatcttccccagcaagacgctaagtcttcaaaatcttagtatcaaaattcatcgcttctgatgataaactcacttagcaattctccccagcgagacgctagtccccaaaatcttgttcaaattacaagtacacaaatcctgtcatgttaatatcacacctctgacaacctacttatcaatcctcttcaataggatgataagtccacaaagttgctccgatcgcaacacaaatcctgtcacgttaacactaaacctctgacaactcacttatcaatcctcgtcaataggatgataagtccacaaagttgctccgatcgcaacacaactctcgtcacgttaacactaaacctctgacaaattcacttatcaatcctcgtcaataggatgataagtccacaaagttgctccaatcacaacacaaattcctgtcatgttaacactaaacctctgacaaaatcaacttatcgactctctttaatagagcgataggtcctcaaagttgccctgatcgcaacatcttcctatcacgttaatatcacacctctgacaaaatccacttatcaatcttcttcaataggatgataagtccacaaagttgcttcaatcgcaacacatcctcttgtcatgttaacaccatacctctgacaatccacttatcaatcctcgtcaataggatgataagtccacaaagttgctccaatcgcaacacattctcttgtcacgttaatatcatacctctgacagtccacttatcaatcctcgtcaataggatgataagtccacaaagttgctccaatcgcaacacaaatcctgtcacgttaatatcacacctctgacaatcaacttatcaatcctcttcaataggatgataagtccacaaagttgctccgatcgtaacatattctcttgtcatgttaacaccatacctctgacaaatccacttattaatcctcttcaataggatgataagtccacaaagttgctccgatcgcaacattctcttgtcacgttaatcctacacctctgacaaaaccaacttatcgactctcctcaatagagcgatatgtctattacccgtcaagttaacatcacacctctgacgacacaatcaacttatcgactctcttcaatggagcgataggtccataaaaatactgttaggttaacatcacacctctaacagtcaaaccccccaatgaacttgttaatcctttttcaacaagaatagcaagttgtcattataaaatccccagtggattaaagattttctagaattatcctagtgataataaagaaaatttttgaatttcactctaagtgaaaattcatgccaagttaatattacacctctggcgtttccaactttctttcagtgtttcaagtaacacaggaagaaataacgacaaagtctacgtattcaacatcgtagcaccaaaatccatgccttttacgcatgggggactttatctcgatccctaattagagataagcctacgcctaacacgcgttgccggttagtctttttccgtaaaaatgacaaagtctatgtattcaaaatcatagcatcaagtctaagagggttcattctcttagcacaacgttacatgtggaacggacttagacaatccacatgctagcccgactcaaacggtagtcggtaaaggcttatcaaatccgttgatggctgagggtttgccaaaaatcctatgcatgtttgcaggcccatcagcttaatggatgtgagccgagacttaaaacagatgagccaaagacaagtctcaaagacttagtcaaaaatgcacggaagccacttccatgtcttaagtcaaaacgttgagatcagacccgcatctcaagttcaaaatgcagggtccacccccacattccagaagcaggattatggcgcataccttcacacaggtcctacgtggcaaatcctttcaccaagatgccttcgaagcaagtgcagagaacaaatcctttacaacaaggaatcaacagctccaagatcagagttgaaatccaaagtattccgaaaattcgtcccagtcaaccgcgaactttcgaaaactttggagggggttctgtaggctgtcaaaaaatcacaatagatagctgatccccataaaaacaccgatgatggaagttacaatctgacgacttcctgaatgctacaatttgaagactttcacgtagatcgctgaaggttacaatctgacgaccttcacgacaaccgatgagagctctagtttaacagccttcacaatcaacatcgacagttacaatctgacgactcttgtatatcaaagagctaaagtaaggattacaaaatgacgatctttgcaaaacttcgatagaaagagacgacaaatcgacggtctcttcaaatcaagacgtgaaagtcctctccgcgtaccagcatcaagatgcgccgcgttcatagccacgaacgcagctcaaatgcagctccaaaagttgcaaacgcagctccaaaagttgcaaacacagctcagattcggccgccaacgcagcttccaaatcactgtaaacgcagccttcaaacgctataaacacaggtcacatccagctccaaacgcagctcagatccattgccaaacgcagctcttaaatcatacaaacacagcttccaaattgctgtaaacgcagctcagattcgctgccaaacgcagctcttaaatcgatgcaaatgagcttccaaacgctgcgtccgagcttccagatgctgcgttcaagcttttaggcattgcgtttggacacagaattcatgccagaacgcgggcctgcgtttgactcanttcaaacacgagctgaacggttccaaaaccgtttcccacgatctgaggggatcacaactccactcaggagtgatttaaggggcggttacatctcattagccccacttaggagcgaattaaggaggtggttacaccccttaatcccctataaataactgaaaatcaattcagttcaaggggggatctgttggaacttcttggctcgtcaacaggatccttagagcatttctggagctttggagatcggcaacaagatcttcttcatccttggcttataaccgactttcggttaaatcaactctttcatagagttttaaactcgttcagagttctccacaacgtcaaatcgtgaggagaagaccacgttccagtgaaacaagacgtcggatcgtcaacgagaagcaaactcgacgcgagcattcgagggaggcatctcatcgccaccgtgaagaacccagaattaaacaaaggggagaatcaaantttattctcttctcttttataatcaggaaatccaattgtaatcgagattaaaggaatacaaatcaattttccttcgtttcttttactgcaaattttccacaaacaattagaagcgatcatggtggtgaattttaaaataaagtttttagtgatttttgtgaccatcatggtattacacctacgttttccgctctaaaaacaccacaacaaaattgtatagttaaacggaaaaatcgtaccatataagagatggcacgtattatgattaatgattttgatttgccaaaatatttttaggcgaaagccgtcaacacggcttgctatgttttaaaacatgttttaattagacatattttcaagaaaactccttatgaactttattttggcaaaactataaatattagctatttccaaatttttggttgcagatgttttattttgaacataaaagatcaccatgataaatttgattcaaatattaattttggtgtatttttgggatatgcatcaaggagtaaggtttatagagttttcaacaaacgaacacttgttgttgaagaatctataaacgttacctttgatgaaactaatgatggcttgctagattgtgtgcctagggatgatgataatattgaggaaggattggaacttatgtaagtaaatgacaaaccctcaacggatgcacccaaagatagggaaaggaaccttgaacaaaatcaagaggaacttcccaagacatggagatttgcaccggatcatcccaaggagtaaattataggaagcctatctaaaggagttttaactcgctcaaaggctatgagcgagtgtggtaatgtagctttcttatcccaaattgagcctaaacgtgttgatgatgctttgaatgatgaattttggatcttatctatgcatgatgaattaaacaatttttaaagaaataatatttggaaacttgttcctagacctaaagattttcatgttattggaacaaaaaggttttttagaaataaacttgatgaatttggcataatgactagaaataaatctcgtatagttgcccaaggatacaatcaagaggagggcattgattatgatgaaacttttacatcagttgcaagattggagcagattagaatatttttagcctttgctagctttaaaattttcaaattgtttcaaatagatgttaaaagtgcctttttgaatggttttattgaagaagaggtgtatgtcgagcaacccccaggttttattgatccactatttcctaatcatatttaccgggtataaaaagctttgtatgggttaaaacaagcccctagagcttagtatgctcgcctctcaagttttcttattgataatagtattttaaaagggaaatttgataatactctatttattagaaaaaggaaaataatttattttggttcaaatttatgttgatgacattatttttggtgccactaatgaatctttgtgcaaggaattttctaaagttatgcaagaacaatttgatgtgagcatgatgggagagcttatattttttttctcggtctccaagtcaaacaaaccaatgatgggattttcgtgtctcaaagcaaatatgcaagagagttggtcaagaagattggaatggagaactctaaacatgcaccaacacccatgagtaccaccatcaagttggacttggatgagagtggtgagaaggtagaccaaaagctttattgaggtatgataggtagtttactttatctcaccgctagtagaccggatattatgtttagtgtttgtgcatgtcatcattttcaagcttctcctagaaaatctcatcttatttcggttaaaataattattaaatatatacatcgcactatagaacttggtttgttttaccttaagaacacttcttttgatctttatggttattgtaatgccgagtttgccggatgaaaggtagaccgcaagagtacgagtggacaatgtcaatttttgggtaactcacttgtttcttggtcatccaagaaacaaaattgtgttaccttatccactatgaaagtggagtacattgccgccggcttgtgttgtgcacaacttttatggataaaataaaatttagttgattttgatttacatttttatgatacaaaaatattttgtgataacactagtgcaattaatatttcaaaaaactctgttttacattctagaaccaaacacataaggtacggcatcacttcttgcgtgaccatgtagataggaaagatgtttcccttgttaacattgacacaaaatcacaattagcggatatctttaccaaaccccttagtgaagaagatttttgatttaggcatgtgctttctttaaatacttgttttgatgccttttgcttgctattgattttaagctatcgatttcatagctactttttctttgtgatctacattgtcaaaacatgtttaagcacactgtaggcgtcaaatttgcttatgagttcccgcacgcaactcgagatggagagaagacgataaacatcattattcaagtcaaagaggattatctgacggtgacaagcatatgaaacgagtctacgaagcgtacgaatcaacaaaacgacagaataacgaagaaacgatccaatcggaagttacgtttcactcacgaaaggagaaattccactcgtgtctcatccactccacgtatgattcacctataggaagttgtagatctcttcttcgactttctgacgcactttgaatcaagtcattccgagattggacgagaaaattacagcgaaaacagtcaaagcgcgcaaaacgacgcctcggtcgaaaaccgagacacaacaagtgtctcagccagccgagacacaaactatgtctcggccagggccgagatacagagagtgtctcaggccagaaaatactattttttaccatttcttcgccgttaaccgtcgagattttggtaaattatgatccaactgatttgaagctatcttggaacgtggttaagtgattacaaataaggatgagatcaaattggcggttcttaatcaaaaaccgagcttctaaagcctataaatatagcactagggccttcattcgcacagatccgaaattctcgagcatcggcaaagcactgtcgaactgaagagtgaggagcacgaatttcaaagaggagaaagagatctcggcaatgtattcagcataaagaggaagagttcaagagatctacatccgttcatccatttttcttgagatcgcacctagctgtgattctcgagaagagtgattatctcactttgccgagatagttactttaatttcttgactcctttgcagtcaacgaaatctatatcttgatcagatcactcgatggtccacggataaacccggcacaggcaaagatcccacataaacagcgagtgataaacgtctgttgtgtgtgttttaagagagttgtaatcttttattttcatttttattaagttcattgtaatgactgaagttgtaatgagtccactaatgaaagaactaactttccaccaaaacacacacaaggatacttagaggagtggttgggagagaccaaggttaattctaagagtgggttggtagtaatgcctaggaagaggtcgtaaatccaaacacttgaagaatatgacacgggtaggtcaacacttagaggagtatcttgtgggttttaacacatgtatattatcttgtttatcccattttgatgttgacaaaaggggagagaaatctctcaatttgtgcacatagataggggagagtcttatagatagggggagaacctatctataaactaaaattttattttattcatgctcttgaataatggtagttttccatcatcaaaaagggggagattattagttctcttgttttgatgatgatttacaaacatcattattggtgttaattgcttgttgattatattgtgtagattataatttatcaagcaagttagtaccaatgttggaggattggatggaatcgagctcaacgatgatatccatggaggtgcaggcaatgtggtgaagaaaagctttcaagagcacaatacataagagaagcttcatcaaaatatgagcaaatatcaagaccaaagaattgtattcatatatgtgagatgtttgcatctttttctttctctctagtgcttgatgtagacaagttattgagttgataacatttgaagctcattaggttcaacacatattttcacaaaagcattgtttttaaactattttgaaaaaagagtaactattcggaaatgatctttcagaaattcttattctaacatggtcaaaatcatgtttataagaatttcccaaagttttataatttttggaatttatttgatattttattttgattttacaaagtcagattttcaactaacatcaaattcctgtatgtacatgttttcggtcgatcgagctttgcccgtcggtcgactgaccaaagaagctattttcatgaccctgcagacagtcatttgcggtcgaccgatttacattgcacggtcgaccgatgactgagggtcagtcgaccggaacatcattatcggtcgaccgaaccagctccagattactgagtctgcaatggtcaaatattcgatcgaccggacatgatccatcagtactataacgactagtttttgtactagttgatttttaggatttgggctattgtttggggttcctatatataccccattgctctcttcacttcagtaatgattttagcaagagaaaaatcttaagtttggttttctaagtgttcttaagcttaaactttcaattcttaatcctcaattgtgtttaaatctttgtttttctcaaatccacactccacaacccttgagctttacttgttcttcacttgatcctatgattctttcattgtgattgtgtggtgagattgatctcgaggagatcacttgtgtggattataaaatcttaagaggagatcgttgtgaagaagttacggcttgcaaaccgggtgtgatagtgaagttagcatcaggagaggttgtcggggacgtaggtcggaagaccgaacctcatgaacatatcgcgtgtcactattggataactgttatggtgttcactcacccaagatacgggcatttgtaaaatgatacaataagagttgtaacaaaataacctcaaacccacttgtgtggcccaagccgaacagaggcctcgacctctccgactcatcaagtcgaccttcttttatgctgacacgaaaggcgggatcaactgaccctatcgccgagggcgacctgttagaccctagagggggggggggggtgaatagggtttatgctaatctaatccgattttatgctaataaaactaattaataaattattcttgcaagatagatatataatatattatgagcaagaatatgtaatatgaacaaagagatatatcctatatgatgaaacatatgcaaggatatataaattaacacaagggtaaataatctaaactaaagatacaattgtgatagggtaatataaacaatacaaacacacaatatgatcacgaagttcgaaccttccgtccaatatctccgctccccactcccggggagaaatccactatcacaatcgggttttctacgcttacccgaacattatttacacctcacactctcattcacggagttcggtccccacgacctacgtctctgctcctcacctcgaggagatctccactacacactctgttttctagctaaccaaaaactttacaatctcacaataagcacaatacaacaaatgatttgttctctaatatagatgagaacacaatgtaagctcactctcaatgatacaatctcacaacctaaattatattattaatgtaaatacaataagctcaatatgggtgtgtgtaacaatgagaataaataagacttaactcaagaagaactagcaataaaattgatatgaaatacaatagtaaaaatgctaggaaatagagttaaggaaacttctctataaacacaaagagaagatgatgaaatattgaagataaactcttcaacaattgatgtaaacttctctttgtaaaaccccaaacttaaaacaaactaaccaagcttaaacccttattaaacttttgttttaaaaacttcttggttgatcatgaaagatgagagcaatggggtatttatagcctcctaaaacctcagccaaaaaccccaaaggaaaagaccaaaaagcccaagaatcagaaatctgattctgtaccaaaatgaccgttggggtgaacggcggtcgaccgtggaattttcacggtcgactgcgagccactttcgagtctgaaaaaaaatccagaaagttttacggtcgaccgtagcggtcgaccgtgggatttttcagactgacggtcgaccgtcatggtcaaccacgaaagtctctgctggctactaaggggaaaacaagggtggtcgaccgtaaacagatatatgaaataacaggtttagaagcagtttgatgattttaaaaccctgtttaaaaatatcaaataaattcagaaaaaatataaaattttgggaaatgattgtagacatgataatatacatactacaaaaactggttttcaaaaaagacctcccaaataaaaaatattattattttgcaaaatagtccaaaacatgaaaatgtgaacatatgagttttgacattttagcttaaccatgttttgaaacaatacaaaatgattttatagacttgaagaaagatgtaaactattgttatgaagtctataaataaagaatatagtattttatcaaaatacacatataatgcactaaaacatgatttcattgaactaaataaaattgatattgataaaatcatatatatgcatataagtatgaaacaaaaatatgttttctaattatattcaattgtttcatattaaaacttaaaaactatcaaactaaaatatatatgtatatatataactatatatatacaaaaccaaaatgtgtatgtgtgtatatgattgagcttaaagtactaacacacataatataaacctaaaactaaattacccaatcttgatcttgatcttaaatagcttgacttggtaatcttacggatgaagcttgaacttggatcttgaacttgaattgcattgcttcaaccactatatccgccaacctccatttgatatgatcgtgaatgcacaattccatccatcctccaacatgttgtttatctacaatagatagataaacacaacactagacaaacaatattagtagtaaattgtttgttaaacatcatcaaaacaaagaggccaacaatctccccctttttgatgatgacaaataatttacaaaaagaatatatacatgaaaggaaatgaatatacaaagtataatatatcatgcatataaacaaaaagaatatactcacaatatttctccccctttggcaacatcaaaaaggagaaaaaccataaagatgaaagagagcgaaagctccccctacaaataagcatgggtgagtataaaataagtatagggattgctccccctatcaaaatgccttatggaaaatatacaataaagatcaaggcaaatatatgtgagcaagcatagataaaaaatatgctaaacaccactcataaaaaaaatataatgaggacacatatagatatatcatttatgaaagaagtgtctcattacacaattatgaaaacatagtataaaaaatagatttatgaaatcaaaagaagaggaatatgagaatgcaaaagttttcaaatgaaaacaaatcaaccaaatgaaatcataaatcaaattttaagtccaagaacaatgtttgatcaataaatagaatttttttttgtagaacttgatcaaaccacatatagaatacattataaggcacacatagatgatccataagcacaaacacataaatatcatcatataagtgaagtgtaatgaattcaaagaaacaaatcaaaacaagatttttgacaaaatgcaagagaggaaacaatttatcaagcacttaagcttgtaacaacccatataaggacttttagtacccggtaaacaagatttaggaataaacacccaataaatccgagggttatataaacgcaaacctcttatcaaatcaaaaccaataatcattgtatgtaggaaaaattacaatgaaaagaataaagaaaattgatttatatttctttgattccgattacaacttgattacaaaagagaagagaacgagtttgattctctcctttgtttaaaactgggttcttctcggtagcgatggaatgcctccttcgattgctcgcgtcgaatttgctctccgttgacgatccgaccgtctcttatctcgtgggaataatgaacttctgtggaaagtttgatgtttaactctgaatgagtttaagaactctgaacgagttagaactctgtgaatagagttgttagaactgaaaattcggttaatgatcaagccgttattctattgttgaagaatcctctcagatttgatcttctgagcttgattcaaaaatcctatctccaaggatttcgctgctgctgttgaatcgccaaaacctgagtggttgagatcttccaaatccgatctttgctcactctttttttttttttttgaactgaaaatctccaaccgtcagcctcctgtggtcgatctgagccaagaaaatcaaacctttagctcagttgagtttgttaagtttttatagggggataggaggttataactgacccctatatccactcctacgtgggcgaaaatccctcagaacgtgggataaatggttctgaaaccgttcgactcatgtttgaacgagtcaaacgcccaatctggcgttcagaacccaacttcgcctcttagaattgagacgcgaggttgggtgttagctgaatatcattgaacacgagggtcgctcgcgttttggcttgatgcctgcttggaaacgcgggggtcggtgttggttggacccctacgaacgcgagggtcactcacgtttggcttgtatcttagagacgcgggggtggcttggaaacgcgggggtcgcctgcacttcacaagttgtaacgcggggatgacatccgcgtttcagaaggagctttttgacttgtaacttcttctgtgaagcgttgcgaggaccgttgttcagtaatcctggctttagctgttgtagggtatgaaagtcgtcagattgtaactttcaccgtagattgtgaagactgctgaatagagttttcatcagtcgtcggaagtgtcgttgaattgtaactcttctcgatcttatgtgaaaagtcctctatttgccgctttcgattgtcgacccgaaagctatttgattgtagctttcattgtgagagcttgacgggaatcaacatccatagtgtttttgaagatgaatatttgcccacagctctctaccaagcaactcaccgactttcgattatcggcgcgaaagctatttgattgtagctttcgttgtaggaacttgacgggaatcaacatccatagtgtctttagatggatatttgcccacagctctctaccaagcaactcaccaactaagtccaacctttcatttctaaaatcattacactgctcatcagcatttccaataattgctaatataatattagtcgtgctgttgtcgcagccatcaagatcaatcatctcagaaatgaggtcgtgtttgtggcgattgtggagttgcggatgcagtgattagaaagtcgtctgactgtgacttcccttatcggagcttgataggggtcagctattcattgtgatttttagacagcctacagaaccccctccaaagtttttgaaagttcgcggttgactgggacgaattttcggaatactttggatcctaaaatttagtggattgattgctccctccgtctgatcgagccagatgatttcaccgttgttagttgtaatctatctgtactcctccaatagactccccagtggagtcgttggtttcttcccggctttggtcgccttgacgattgctgttagctcttcttttactcatctggggctgtgtcatagccttggtagtcaagaagctgctatcatagcggtccaaacacagagataatttctgcctttggggattggaacgcgggggtgagcccagcgttgggaaatttgaacgcgaaggtgggcatcgcgtttggaagctcaaacaactcgaacgcgagggtcgagtttgggcgggctgatggcctcgaatcctgtccgttatgatttgacagctcatagctgtctataaatagaccgctagaggtcaaatcaagagtcattcggctcttcttgaaattttaacgaaaaaattttcattctcacctccgacaaaacgctgtacacctcctccgacgagtttcaatggcacccaagaaatcagccgcttccaagtccgatgccgctgcggctcgagggtcggcatcgtcagcgttggtcggcggcgctgctgctcaggcggatgtgccgccccagcttcctttgattggtggtgagtatgacctccgtggccattaaacttgcttcggcaagttctgatcttgagatcaacgaggaaactcgtttcaataacgcggggctggactccgtcgtttggtatttctgacgcggggttcaacctccgcgtctcagatttttgaggcgggggtcgacctacgcgtctgaactttttgacgcggagttcatccttggcgtccaagcttatctgacgtggggttcggccttcgcgtctgaacttatctgacgcggggttcgtccttcgcgtctgaacttatctgacgtggggttcgtccttcgcgtctgaacttatctgacgcggggttcgaccctcgcgtctgaacttatctgacgcggggttcgaccctcgcgtctgaacttatctgacgcggggttcgaccctcccgtctgagtcttgcttttgagttatctaactttcttcttccttttgcagtgcgccataccagtgaaccccttctttttctccaccattttgggcatgaaggtggtgcggacatgaacattgctttcagctcacgccaagaactccccgttttccgaattagggagaagagtcacgtagaaataattacccaagcttcttctgacactcttaggacattggttacggacgcccgacttgaaagcccaagccgtaagccaatagtcaaacctggatatcttttcggggactttgttgacttcgacgccagcactgcttatgatggggactataagtggttgcggaaagttggggaccgcaaccttttcttgcccaatatggagaggatgttccccatatcttatttccagtgtgcttctgtcccaaggcatatggattggcccctggttaagaatcaagatggggttgctctcgggactttgacttttcacggggtccgcacagttggttataaccggcaggtgacagctttgcggccgagtttatttgctaaggagtatccccttggtgaagtacccagcccagcgaagacctttgttaagagatttttggaaaagaaaggagaattccccgcacaaggatttagagctcctggttgggttcattctccagtgtcagggtggtgggcccagatgaccaagtttgttctggaggaattggaaacccctcttgcccaagctggattgctgattccagtgtgggctactaagttcgggattattcagagccactttcatttcttttccatattggagaagtatagtcccgagacttgcactttcttcacccctgtggaggagttaggcttcgctcttcacgagatgcacgaagtctcaggtcttattctaggggatttaccctatgaagaatttgttccgggatctacggaacttaaacttttgaagaagaccagcccagaaatttacgccactctctgggaagtgatgtgtcacttccatatctgcatgcagctaacgggggctcgcggaagcggcatcaaacaagtgtcttgggcagaatatttattccagaacttgaccactaaaggaggctctgtgacccgattacctgtcagtactttggaagaggttcaggctcgtattgacgacgctacccccattacaccaatgaggccaaggaagatgttttcccggctcacacagagtttgagagctttcattatcaagctctgattcccatttccaacgcggcgttgctggctggattcttgatgttgtggctcaagcgttgcgtcgttcctaccaggccggtcgatgcccttgctattgaggtggtctacccggctgttctcttggcacatgggagacctgtgagcctcctcagcgccatggtgggttgcttacagtatggactgcgggagttggcctctgactttgttggtgttacagagatggagtctgagggtcacaagactttcaaaactcccaatcccagggtaccaatgccatatgcctatttgatggcttggtacgtgcttcactgtcctactttgatgagtgcagcctctcccccggaagactccttcatcccatttgtgcagcgactagaatctgcgaaatgggtggggggttacatggttagaattcgccaaatccttgcgcgagacaccaacttccatatctaccgctgtttccctgatttcgaaggcggtgtctatggggcagaatatcaggatacggcaggtcctaatggattcactcagctgagcaggggtgttttccattggcttctatccatcaggccaggctacctgatctttcggcaaggcgtcaactgtttcgtcgagccttaccaaccctataggtttgctcgccaatttgggtatgatcagttgtatattgggaaccctcgccctcaactctcagttatagataacttatatgaaggagccagggcctggtattattctgtagcaggctgtaccaaagccgtcttcaagcttccccacaaaactgctaactcctatacctccatcagcttctgtaattggtattacgccgcttctcagactcccaactacaacttgaataaatcttgcctgaaagacattaggcatatgtataatttaaggaaggggtccaagacatcccgcttgaaagggatcgatgagtttctgtccatcgagaatcaatctgctagacaagaagaggaacagacagctgagcctgctctaggggaagagcaacgagtggttgatcctcccgtgacaagagcagcggggaaaagaaaactttctgctgatgaagccggccagtatgataagcagatccgtcagaaactgctggtggattctccccccaaaggccaacaaaaatccaaattgatggctgaggccatcaaagctgctaaagatgacgaaccacaggaatcatctgtggctggcctgccacacagagcgggacttcgttctcatggcccagctctgtcgggcgaagtttcttcttatcatcctcctgaggacgaagaagatgaattaatggctgcagatgcagagtctgctccggtgatggatcttcctaggtctcctgcattggaaccagggggtcttgaagataatccatctccttctccttcagcattaatgtcacaagctggtgatttaatgcctaatcctacaacgggacctatgaaaagaccagctgcaggtgcaagtctccctgagccctcagctacccgggatgatgaggagcgagttgattatgaagactcctcgattggtggtgcagctgacgaagatagagatgatgaggacgctgacgttggcaacatgtcaggtggtggtgaagatgacgaagagcatgattccatagatgacgtcaccacttttgatgatgacgctcccaaggtcccatccgataaagcatctggttatactcctttctatcttagcggtaagcttggtttgtttcgacttcttccacatgctttctccacgttccgaccattttttcgtgcaggttcaccttctccaaggactactgctgctgctgcttccgagccagaacctgctcaggtgtcggctcctttagaagagcaacatttacctggctctcttacggcaactgcttcacctgcagcgttgcctgaaactactgccgcaactccttcaccggaacagcagctcgtgcaggtgccagcttctatgcaagagcaacccctgcctgactcatccaccgtagctacttcatctacagcattgatgaagatctcgcttgcgcccacagaggccggaccaagcgaatctccggcgagggcaatgatggccttgacttcaagcccttcgcaattgaatattttagttgcctccgcgacttctacacccaaatcacttgccaatccatattttagcatgtcaacttctggggttgtagagtcatcttccattgctttttctagtccaacggacgctcctgacttcctccatatgtccttgagctacttaaacagtctcgtgcggaaggtgattgaggttgtcacagctggtcgaggccgcttcgactcctttaagtctctcttagaagcaggcttaaatggggtcaaaagtgtgggcaatgctcattgctttgaacgttgttcggaagccatttcccacttagaagcccgactcaaacatttggaagcccacagccatgaagacattcatacacagatcgtgtctacttttgctgacttccaggttgaggaagtgactcgccgtgaggcaattgagcgaggcctggctgaaaaagagcttcaagttacgcagttgcgggaacagagcgatctgagacaaaaagaactggaactctcaactgcttctttggacctcatttgcacgaaacttgtcgaagctgaggcggaggtgttaaggttgaaggccgagctttctcgagaagaagccgttgttaacacccttggggccaagaatgcagacactcttttgaactaccgtaaggaagctcaggctcttgaaagagcgaagaaggaggcagccgctgaagtggcacccagtgaggatgagctgcggaaaaaagctgaagcctttgtgcgagccaatcatgaggagaagctctctgatgccaaagctcaacttgcttcttttgacttgaactcgtactattcttttgcttaagaacagctttgtatcacttctttttggtttctgaataaaaagtgatattgacttctcattgtttcttgcatttattatgttttaattttaaatacaagtcatgagaaatgcctgagatgtattcctgacttagaatagatctccacaatggttctggtgcagaaaactctctttattatcgtttaaaataactctagaaagttttaaactgctgaggatgaatattcccataatggggttgactagtagatttcttcctatgttatttcttgctttgaacactgaaagaaatctataagtaccagaggtatagtttcaacttggcatggggattattgatattgtcagaggtgtaatcttaacgtgacaactgggatattacgatcagggcaattttgaggacttatcgctctattgatgagaatcgataagttgattttgtcagaggtgtgattttaacgtgacaactggaatattgcgatcagggcaattttgaggacttatcgctctattgatgagaatcgataagttgattttgtcagaggtgcgattttaacgtgacaactggaatattgcgatcagggcaattttgaggacttatcgctctattgatgagaatcgataagttgattttgtcagaggtgcaattttaacgtgacaactgtgggggaaggatattatagcatctcactggggagaactgctaagtgttttaccatcggagcgatgaattgtgatacttgtgatttggacaaggttttggggaattttgttaacccgctggaagcaggttatttattgctctgctgaggagagctaataaattgacaatgagttggagacttatcattctattaatgagaattgataagtggattctggggtgcaatattagcccgatgagaatttagattctgctgatgagatacagaggttttgactaactctctgttaagagggctcatgactttgagggataagtgttgtgtttgatgacacaaatgtagattcttcatttagaagaattataacgctgaagtgaccttcgcgtttgggattcagaacgcgaggttcgggccttcgtggcgctagcctgagctttgcactcgggaaattgaacgcgatagtgagcttcgcgttttgaagatggttgggattcactcctagaatcctgtaccatcttaacagcttggcggctgttataaatagacctgaatggtcacatcaaaagtcacttgactttcaaaactttcggctatttccaagaacgagaactctcgtttgactatggcgagatctccgacaagcttcgtctccctcgttcaaaggagtttctttcgatcgactgcatcaatggcgcctcggaggacgggttcgaactccaagaaggtcgctggagcaacttccgacatgccgtcggctgagaacgccggcggtgctcttgtccatgcaggaaccttgccatcgacatcgccgccgcaggggcctccctgtcgtggtgagtgctgaccgaaataacttgccatggcaagttctttgaaaaccctagatgggttcttgataacgaggaagatgactcgttcaatgaaaacgcggggttgggataccttatgggtctcgaccctcgcgttcaacttgttcaacacacggttcgaccctcgcgttggagaattctgacgcgaggctcgaccttcgcgttggaaattttgacacaaggctttacccctttgtgtttcagactctgtctttatgtcgatagctcgcttctagctgctaacttctgcttttgattgtgcagtgtttctcccaaacgtgccgctttcacaagagcaccatttcggatatattggtggacctgacccgaatgaattattcagtctttagaacaggattccattgtgtacttttcctgattcggaaagagcggaaatgattaaattccctcaatgctctactctcaggattttgataactgacttggacttggagacccctgttggtcatgcccagtttcccaaaccagcattcatatttagagatcgcgtaccagtcgatgaccatctcacatatgtggaagattcgaagctgctgtggagagctgataatagcttcttattcctcctaaacatgaagaggatgtaccctctctcctactttttgaatatgagctgccgtcggggtttgaccttcgacatagtaaaggagaaggagaacgtgtcgcttggatttggtcgacgggctcgtacagaaatcggggaacaactcaaggggttaaaacctggtttgtttgagaagaaagagctggtttcggaggtgccacgtccagcgaacatttttatccgccaattccttgcaactcagggtgaattctctacccagacgttcaggtcccctggatgggtctgttctctggcgaaggaggttggtggacccgcatggttgactttgttcttgaagagcttaaggactcgctcgctcaatcgggtctcacagttcctgtgttagctacacgacggggagtcgtgcagagccttcacaacttcttcgctatgttggagaaatataatcctgacagctgcacattcttcacgcctgctggagagttaggttttgctcttcatgaaatgcaggcagtgtcggggctgtcacttggaaaaacgccctacgaggggtttatccctaccaccgaggagctttccttactgaaggtggcacacccggaaatttatgctactttttgggaattgatgtgccacttccacatatgtgcccaagtctttgggatgcgtggagggggtattatgcataccacatgggcagactacctctttcaaaacttaaatcggaaagatgtagccgtatcccgtgtcgcagttgtctcacttaaggacgccaaggctcggattaaggctcctggtgctacttataagacagagcatgccgaggatgattttgaagctggtgtcgaatttgaaagtttccactaccaagccacagttcctatctctgacacggctctacttgcaggcttcttcatgatttggttgaagcggtgtgtggtaccgtcaagaccaatagaatcaatattggctgaggttgtgtacccagctgttttcctagcgcatgggagacctgtgagtctccttactgctatggttggctgtatccagaacggcctgagggtattgacttcagaactttttagtgcttcaggagtcaaagctactaagaagaaagctgggaaggctcctcaaccacgtgtacctatgccatatacatatttagtggcctggttcgtgttgcattgcccttccttgatgacgggagtgcatgaaggggatgatgcttatactcccttcgtacaaaggttggagtcggccacgtggactagttcttatatagtcagggctcgacagcttctatcccgggaagataattaccgggttttctgctgtgctcctagctttgacggagctgatgtggagaatgcccatttcatggacttgctttttgaaggctcatcttctttggaagagggtacattcagctggcttcttatgatcaggttgggctacctggtctatcgctcgcgggagaagtgcataattgagccttacatgccttcacggttcgccagacagtttggatatgaccaactctatgttggtaatcctaacccggcgttagctcagattgggaatttgtatgaaggagctcgtgcatggtacttcttctctgccgggggaacccatgcgcaattcactttacccaactcaccacccggctgttctgctgttatggatttccgccagtggtttgccgaagcttctcatgtctcggaatatgacgtttatacctcatgtataaacgagattcgggaattgtatcgttcacggagcggttctgcgagtactcgtctaccagggatggaagagtacctatcttgtgaacaggaagcgaccggagccgttaaagctcctaaggacttgtctaccgtataaccttctgaagaagaggttcctacgggaattgaagagggaaagccaattgatgattctcccgaagaaaagacaactgaggagattcctgcagaagagcccgttcctacacctcgttctctaagatcgggtaagaaagctctttctgctgctgagcaaggtgagtatgacaggagaattcgcaagcggatacctgtcatggccaaaaattccaaaaaggccaaattaatgggggactcgatgaagtctgcactcgttgagcgtttagttgacaaagaggacgaaatgccccaatcgattccttcgattcctggggacgatagagctggagagggcccttcttctgaaattgctccaacacctgttcaggacgaacatacgggtttaatctatccaacccttcctcctccacgctcgcgggctctgaagaaatcgattgatgaactggaacgttggatgcaaacaattattaatattatcagtgttgagggggcttctcttgaagactgtgcgtctatcttgggccaatgtttggacgacatcaaggctaaaggggatgcatcctggactgagcactgccaagggggaatcactcttttgatgacagaattagcagttttcagggagctacagcgcaccaatctagattctgaagtggagccggctctttccttggcgataatctcgagggcgcatcacccaggggatcttcgcaaggaactgtctgataaaaaggcccgcatatcagctttaaggaagcggcactctgcaacatatgctaaaatcaaaggtgttgcttctgatatccgtggtatcgaaaagactatcgctcgattggaggccgagttggaccagaagaaagcccaattggcccactatgaggatgtcagaaaagagcttgagcatcaaagtggccaaatttatacgaaattttgccgtacactccatgcggctgagcgaactcgtaaggacattgttgctacccttcctattgaagcagaactcagaaaggagatcgagggacaagtccaagcggctcaccgggagaaactttctgccttcaagtctaggctaaaaaccctcaagttaatgaagcctgatgtttagcccttgacttgttcttggctaaagaatttcgtatcattttcactttgtttgtcattattttgtgtttagattaacaacattaaatgaaaatgatatcattttgccctgtattgtcttcttttgctgaaatctggctctaaacaatagagaataatgctaatactatcgaaattctctttttcatttattagaataattctagcaaattacagtcgtcagaggtgtagtgttaacatgacgaaatataaaacagaattacactataaatgggccacccccagcctgatttaactggggtttagggggccgcatgatttacgggaagtatctcttaaggaacttcccattaattggcatcatgagcctatctccttcttggttgatgaggcgatatgctccgttcgaatagactgattctattacgaatggcccttcccatttaggattgaacttccctctggttttgtgtgtcatcaccatgggtcgtctgttggctaaaactaaatcgcctttcttaaaaatccgttccttaacctttttgttgtaggctttggaaatccgggcttgatataactcgatctgttgttgagcctgaagtcgcttgtcgtctaaggcttcaagttcttgcagacgtcgttgatgcttttcttcttctgttagtccagttgtgatagcgactctcagagaaggaatctagatttccaatggcaatacagcctcacagccgtataccaaagaaaaaggtgtggctcttgtagaggtccttaccgtagtgcggtaagcccacagacattcaccaagtctttcatcccaatcgcgccggcttttagaaacaaactttttgagaagcttcactatggttttgttaaaagcttctgcaagaccattcgctggtggataatatgccgtggatgcaacactttggattctaaatttgtcacagaatctctaaaacccaaagctgacgaattgtgtcccgttgtcgtgaactattcgcctcgggactccaaaacggtagacaacgtgatgcttgatgaacttgattacgtttgaagtcttgacttcttttaacgggattgcctccgcccatttggagaaatagtcggttacggctaaaatgaaccggtgtcccttggacgtcggaggggaaatcgggccgacgatatccataccccacatttcgaatggccaagttgctgatgtggggtgtaagttccctggcgcttggtggatgaagtctccatgaatttggcacgcgtgacaacgtttagcgtaatcaaccgcgtctgaaaacatcttcggccaataatagccgatgcgtcggagtcgatctcctaatttagctccaggctgatgagctccgcactttacgccatgagcttccttgagggcctcttttgcttctttccgggagagacatcgaagcaaaattccatcatgcgatttacgatacaggacttgagagactgcatcataataaaatcggagggcctttcgtttgatagaggccgcttctttagggtcatctggcagaattccatacggcatagtcgatatacgggaatcgccaatctctggattcaaactccatagaagttgtacagacttcttctgacgtcgtctcgtctgggttttccttcatggggatcttggaagagcataatttccatcccgcgactggaatcgttgtttcaacccccggtggcaatgctaatgaagttgccaaagaggctaaagcatctgcatacgcattctgagctcgtggtatatattcgataaagaaacattcgaacttttgagcttgctttagcaccgcgaagtaatacgggattagatcctcgtgacgtacttcgtattccccccggacttggttaacaatgagttgagagtcaccgtaggcctcaagatgctgaatattgagttcttcagataattgcattcccattagcagagcattatactcggctacattattggtgcaaggttcgattaaggagaatcctctgggaattacatggccgttcggagagattaatactactcctactctcgcggtgattgctccatgaggatttgctctggatgcaccgtcgaagaataacttccacacttgcgtagcttcttgagtagcgcaagcttcggcgacttcgtcaggtaactcttcatacaacttagatgctcccgatactggatgatcagctaagaagtcggctagtgcttgacccttgactgccttttggggcatgaactgcatgtcgtactgcgacaagagaatggcccattttgcaagccggcaattcagagatgctggtttcgtcatcagcactcttaagggattcaccttagagatgacctgaattgtctgtccaactaggtaatgtcgtatcttttgaatggcgaataccaaggcgagacatttcttttcgaccggattgtaccgatgttcggctcccatcataatcctgctcaggtaatagatggcttgttcttgaccttgatcattgttctgggctaacaaagcactaagagaatgatccatggccctcacatataacaggaatggttttcctgatatcggggccacgagaactggcggttgagttagatatttcttaatctcctcgaatgctctttgacattccgcatcccaaacaaaggatattcctttcttcataagcttagagaaaggttggcagcgccctgacagatttgatataaatcttcgaatgtaggccagtctaccttgcaaacctctgagctctttgagattcttcggaggtggcatgtcttggatggcgcgcactttctctggatcaagagagattcccctggaagtaacgataaatcctaggaattttccacttgagactccgaggaatgattttgtcgggttcatcttcagctgatgtgctcgcatgatctcgaacattatcttcagatctgtaagatgatcacctttacattggctctttaccgctatatcatcaacgtagcattcgatcttctttcggaggtgttcgtgaaagattgtgttcattgcacgttgataagttgcacctgcattcttcaggccgaagggcatcactgtgtaacaatatacccccagcggtgttctaaaagcagtatgctttttgtcgtccgggtgcatcttgatctgattgtacccggagaacccgtccatgaaagacatcctttcatacccgcaggtgttgtcaatcataacatccgtgataggaagcgggaattcgtctttcggacaagcggcattgagatcgcggaaatcgatgcatatccggaccttaccattctttttgggaactggaacaatgttggccacccagtctgggtgctgctcttccctaacaaaacctgagtctataagctttttaacttctgactcaattgattccatgatctctggacgaaacctgcgttgttgttgtttaacgggttttgcgtccggatcaatgttgagatggtgcatggcaaccttcgggtcaaggccgggcatatcttcatagttccaagcgaagacatctatatattctcggatgagagatataaggtcctctttctcggatgatgacaagtcttcagctatgaatatgggcttaggatcatgttcatctcccatgttgacctggatcactttatcttcagtgggtggttcgcgttgttcgaatcgcatatcccacaagatattgagacgtttgatccaaggatcattggtcgattccatcaactcctcgtcatcccctgcgtcttcatctagatgactagttgagaccatgttcacagtcaggtttttgaagaaaggtccaatactgacatcggactcgtatgaagatattccagacgaatggtcgtgacgcaggtaattactgatttcgttttccgaagcggggggaggtgtaacgtaacccatgcctcttccggttttttgataatagtccggaggttttccttcaggagtgagagacattcggatcggcgttcgccttcctttcccgaagttaaggccctgtttctcattaaaattataccccattcgtttcattaagtatatagaattgggttcatggtaatggaattggggaactccgtcgtcttcctctgaacttgctcgtttgagttgttcgggtttgactttaccaaaacagatcggcttctgccctttctttttagatgggactttgaagaaagccttctgtgcgtcctccgcttcttcatctgaagcgaaggatgactgaattggcaaggtaagcgacgcctctgtgcacagtatgtgccatgggttggtacctgcactagaattattctctatttgttcattttcaggagagacatcagacaagtacgctaaaatgaaatctttattaatgcaccactcgccctcactcggtacatcattattactctcaccctgacccattacatcaaaatttaattcccaaggacaatcttcatcgggatctggctcaatgtcagcctcattaccgctgtctacatcttctttctcttgggattccgaatagaagacggagtcggtatggaagttttccacccctcggaaggggtatttttctgcaatcaaggttcggacttcgccctcgtcattggcgtacttcataacctgatgcaaagtagatgggacaatgcgattcgcatgtatccatggtcgtcctagcaaaagattgtaggacgtgtccgcatctatgatgtagcacgctacttcagacttaagatctccgatctggcacctgagcttgatctttcccaggggtcgggtactgtttgcattgaacccgaagatagtagtctgggtggtgtgcagtcggtgcataggaatccctaagacctgcatgaccctgtagggcatgatgctgagcgctgagcctgggtcaacctgaacacgactgatttcagaggatccaatataccctgtgtagtatagtggtcggtcatgttcgtgtttgacctgcatgtcttcctgcgtgaatgatatgcatggtagacttcgcgctgcttgtaggcattgcagacaaagttgatcttcaaaggcttcgggagtcggagttacttgagtaatgaagctctccgtattcttcaaagctttaattagagcttccttggtggatttggataaccttaggagctcatatagcgtaattctggccggtatgttggccagctgcgccatgacgttgaattggaagggagcgctcgactctccagattcttggtggagatttctgttgaatcggagctccttctgttttcctttgtccactggcttttttggggcagaacccccagcgtcttggggctgctcttcaacttctggagcattctggccgtaatccctcaagtaagtttttcctgaccgagtgccagggttgtctcctgggtatgctgccagggcgatcctctcctcttctgaatcagtaagaggtttgaggtggtcattattctcagtaatggaggggctaatcatgttggaagacttagccttgcctcccttctttttggacgaggtgcttgtccattgttgatctcttagcagatcaggatggacccacatgatttcccctttttgggtagtgagaggcactaaccccctgtctttctgactatgcgggtcaacattcttcaggtgcatttctcccttgcgaatggggatgacgccgttcgctgttaccactgggggaaagtcaccgaattggaccgctatcatattagttgatacggtcttctactctggcttcaaggtgagtacattagcattcaccaaattctgcaagatgtctttgaagacatagcactttttggtaggatgtccaaggaatctgtgataacgacaatagttggggtcatccactttccctgcttcatccggctttctgatctcaggtaattgcagcttgttgttctttcgaagcaattggaataaggtatccacatgctcctctttgaacgaatactgcttgggcgctctttgctgatttggcgccttgccttgtttattcggcggtggtactcgcgtgtagtcggctgccaaagtctcctttcccttagaccactgggcattttgctgattgcgttgctgctgcggcttgggttgtggcacttcttcaactttgactcgcgccactatctcttcagcttgttctccttgtgaaactagttgtctccaggagcgacattctgccacccccatttgagcaaggagctgggtctgcaggttgtgcctgcaagtttcaaccagagttgattgggtcatacctgaggggcatcgtaatgccatgctgcggaatctctccacataggccttgatggactctcctttcctttgcttagtggcgagaagagttgggactgagacctccgtatcatcctcaaagaacctggccaagaatagcctttccaggtctacccatttctggatagatccagcgggcagtttcatgaaccattcgaaagcaacacctttaagagtgccgataaacaagcgcgtcaggatggcatcatttgctaccacatcccctgtttgggacttgaagtagtagatgtgctgatttggcgatcctgtgccatcaaacggttgtaaggtaggggccttaaatttcggtgggtagggagctgtatcccactcagcagggtaaggccgcactactccctcttcgcggagctcgcttcggttggcgattgcattgaggcgagcttccagttcatccaccttggtagattgagggtgcagttctttctccatctctctctcaccttcggaagaggatcctaggtggtgagtctcacgatccgaatgttcggtcgctttttgttttccctttgaagtagtcctccgggaagattcaggtttttggcctttttcggcaaggagctgggccaacatatcctttaactggagaagtgtctcctgctgtgcctggagcatgacatgatgttcgtccactcttttggttatgtcttcatggttccctgtcgtgtaagcggagacttcccgtgctccgacagagcttgaagattgagattcggctattgccgaatgttcatcacttgttgtaatccccttggctaacttttgatagttaaccggacgaatagctcctgtctgagtccgagtattctgatatacaccttcgaactggtcacaaatttctcggacagtcgggggatgactctcttgcgactcatcggagtcagtatgcgaagctttcccttggccgatcatattgatagtgacctgagggtattccgcttcagctgtcttctttctgcagcggcgttgtcgtttggcaggcctaacgacgttcgttaacctgtcgaatacggactgtcgtggtgtgggtgcacaacaagggcattctgacaggactgctgaaatcagtctctcacattgacatgagtgagctgcttgtattgttggttttcctcttgacaacaattcccgtaggtcggaaacttgggaggaaactttccctgggcttggaggcggagattgaaccccctgcccttgggtaggtgaaattggttctcgttgaacgtggattttgaagccacgctgattcttctgaacctggcggacctcttggagatcgcgttcttgaaggataacgcgagggtcgcgcttagctttgaaaacattaggccgaggcctacgtttaaatgatgaaactgacccatgagggtcatgtttaggttgaacgcgcccctgagggtcgcgtttaggttgaacgctcccctgagggtcgcgtttaggttgaacgttcccctgagggtcgcgtttaggttgaacgctcccctaagggtcgcgtttaggttgaacgctcccctgagggtcgtgtttatgttggacgctcccctgagggtcgtgtttaattgatgaaacagactcccgagagtcatgatttattggaacgcgcccctgggggtcgcgtttggttttggcagccctcctctgagggctgcgttttgaagaaacaacgcgctattcagggtcgcatttcagctgtatgaggcgaggttcatagttgggctcgttgccgcgaagtgagcgttctcctttgggaacgctaggctctgttggattttcagaaacgcgatcttcgcgttgggccaacagtcagctttcacgtagatgtgctcgtcgtatggatcttctccgtcggcgagcggcgttcttcttggcttgtttcaaagccttagcagcagcatcgttgacgcttatggaactcgtttcctccagaggccgtttgtggcctgaagaacgtcttgctgacgcggatgtgggatcttccgccagcagagccagtttgagttcttggccgaaggagagggctttcttcggcacttcgacaacagaattgaccttcttggaggtctcgcggacatcgtgcttagccttggggctaagcgatcctgaggataaggcttcctcgtacttagcttgatcaaactctacgacgagagttcccaactgcctaacgtcagccacatggtctaggagagattgtctgaaattcgcataagtcccccaaccaaggccgacgatggagatcacttactttgcaatgttctccaattcattaaggtgagcctgtagggagagggagcctaaagaagtaggctcctgaccgcgggcaagtgttgtgaaaagcgggatcttggggaaaaccctgtttctggctgaggagaagactgcaaatcggatgcggtcacagcttcctctagttcgtcatcagagatgaggattggtttaggttcaggctccccaacagctggcgccccctctcgggttgcataacaaaacaaagaaattaaaatcgtggactcatctcgctcacacggcctttaacctgccatgagggttagagatagaagtcgacttataacaggcatgagtcgactcaacctgatgggtcgacttatgatgttgtgagtcgactcgttagaaacaaaatgtaaactacacgacagtttattagtcgactcaacactgttcatgagtcgactcaagacatgcacacagtctgttttaaacagaaatctaattttcaaacatcttttaaaaatagcaaataaaatcaaaaaaaatgtaaaactttgggaaatgattgtaaacataataataaacatgttacaaaaatttgtttttaaaaaggacctctcaaatgaaaaatatcatcatttttcaaaatagtccaaaacataaaagtgtaaacacatgagttttgatattttagcttaaccatgttttgaaacattataaaatgattttttagacttaataaaagatgtatatgtttattgttaagtctaaaaactgagaatacaaaatttttataaaattgcatattttgcaaacttttcaaaaacaataaatatgatttcattaaactaaataaaattgatattgatgaaatcatatatatgcatataagtatgaaataataaatgtattttcaattgtattcaattgtttcatattaaaacttgaaaactattaaaccaaaatatatatgtatatatataactatatatatacaagaaaccatagttaaagtgtgnatatacaaagaaaccaataaaatgtgtgtgtatatatgattgagcttaaaatacttaacacacataatataaactcctaaactagattacccaagctataggtcttcaataagcttgacttggtacacttacggatgaagcttgaacttgaatctttaacttgaattgcgtagcttcatcccacgattccgccaacctccattggatatgatcgtgaaagcttgattccattcatcctccaacatgatgtttgtttataataaatagataaacacaaacactagacaaacaatattagtggtagattatttgttaaacatcatcaaaacaaagaggccaataagcataccatctgctagatggtagaatgacctctagcccctctgaaaaccctccagaagaagacacaccataagggtggttgtctttcttgaaaagcaacattggcttctaatcgccatcacagaataactttagccaaaacatagaatttgatcaggccaaatattacttaagctctaactgtcaatagctcatatgagcataggagcagtgattaagtctgtgataggcgccttggaccatgaggactttttgaaaggaactcttatacatcagggatgagattgtgggaaaaacttagggcctgtcagctgattgtcttctcaagaagaatgacattggttcttcaattgacgcctgcaccactaaatttacctaagctctggtggtcaaagcatgtgacccgtatgatcctcatgatccccataagggagagttctctatttacatcatgctccagtccccggtactcctaaagctcattcgaggaaaccgatatggtttgtcattttcagggagtacaatatcggctggtggattctctctccaagagaatttctaccacaaaaggtaccatatagcttccgatcgtgcccccaaccctcgtgaaccagacttagaaaacatcattcaacatgattcgtggtgtctgggtagttccttttgctaaaatccggcatactaaccatccgccttcaaggccgtactgaagattcagactcaaaaggaaccttggctaatgagatggcaaatggagtttcgactcatcttcatctatcattgagcagtccgctataaaaaagaaaaaaaagcaagcaaaatccaactagagaggttctatattggcagcctcatccattacaacactgcctttgtgaaaaaaaagacaaagcaagaccacaagtggttcaaccccctttttgggcaccagatacctacaaaagatatttttcatgatcatgtaaattttagaattggtgaaatcttattgaatatgaattaactcatatttcgtagggattaaggcttcattatggctaaagacctaagcactcccaacaagcccttggtaccttatcaggaataaacccaaggcacaaccctttggccgactcccatagtcgtctcacagccttaggggaaagaaagacctagtcgactctctcgagcctaggcgttcaacttcggagtcggattacaagctcttggtaccttattaggaataaacccaagacataaccctttggccgactcccatagtcatctctcggtcttaggggaatgaaagacctagtcgactctctcgagcctaggcattcgatttctgagttggattacaagcccttggtatcttatcaggattaaacccaaggcacaacccttttgctgactcccacggtcgtctctcagccttaggggaaggaaagacctagtcgactctctcgagcctaggcgttcgacttccgagttgtattttcatgtccttggtaccttatcaggaataaacccaaggcacaaccctacgatcgaatcccacagtcagcattcgacaatactaggattatgaagacttaggcacctacgtaagacctaggcacccaacctcagggttgtcattctgccaaaaaaagtattcataagcctaaggtatgaatattaagtgtatggccaatacttaattgatctaaaaacttaagcactcatctgtcaagttctggtcaattaaacactcagccaaactaaggcatcagatgaactagttgtcataagtccccagtatgggtcgacacattacaactaactcgcttcagccaatatttcaaacaaaaacaaagttacaaagctaaaagaatataaataatgaaggcaagctcaagaatggagacaaaagttaattttcattcaataagagtaaacttcattacaaacttctctacaataaaaaaattgaagagatacgggtcttcaaagctctcgaccagatttgggagttagacttggcggtattcgggtggtggcagttgcagaagattccctaggagccccagcaataggttcgacctcatcatcactcgttgataaatccaacccgcctccatttttctcgacatcttttaacaaatcgagatagcaggaaacacggggaggatagaagcaatctgaagtaggatgagagttgcgaggcactaaagaagcaaagtaatcgactccggccttacatgctagggccatctcggctttccatatagaaccatgatgtcagttgtcgaccaccttctttttatgctgctctgaatctagataaatgattttttttctctagtttctggacgagggctgtggacgcccgaagctttgattgtatctcttcaaagtcccttctcatcttctcgagagataggcgacttgattgagcctctgtctcagctgtcatcctacgactatctcagactcaacctctgcctgtagatgaaccatctctctttgaaggttcttgatggtctccaccaacttggagaactggattcgaaagctcttaaggagctcttccttctcatccagactccggcaccaaacgccttctttgtgagctaactcggtctccaagatagtgatcctcttcgttgcctcttccttgggcgacttctccttagccaagcctacttgacattccaaggaacgctcaagtcgattaaataaggtgcactccagcaaagtcccccaagccaaacaaacctcgagagcttggtgtatgccaacacttagcatatcctccaaaatcctcccgtcagtaccattgtccatctggtctgacggagtttcagctctcctctcaacactattgtccatcccaatcagctcctttttaggacgacgagacgccttaggaatagtactagggccgacgacatcctcctcgaccgctaaggctgttatctccctgtcaggagaagactcatctatccaccccatattctccaagcggttaagctaatttaccagtgaaccgatcccagttggttggagcttcccaatcggtccgattgggcgccatctctcgacatttgtcctcctccttaattcaaagacaattttagtggcttgaggcatcaagacagccacctcctcagcactgaaggcctccctcagctttttatggtgcctagaagtggaactcaactcctcggtccctgcattcctcttgtgactttctgccaacagaggaacggggctcgtccttgcttggaagccagtggaagacaaaatcatagatatgcccaccgtttggagagacacatcatcaaatagatcatcgctctctcatggtacagcataaaaaacagaccttgtccagaaccattatctcggaatcactaagggtgactagcctcaacgcgtcttcattcgcctccggccagcccgagcaggcgaagacattgtcgccaccatagacccacacaaattgctcctctagtcctcatccaactccaaagaatttgagacaagctggaattcaccatgatagtgaaaggagtaatgcgggtccttctcagctgaccccacgccgatcaaatgcccaagcaatctcaagcttggttggactccaacacgatggcaaatgatgatgaaagccaccagaatccccactgtgtttggatagaactggaaaggggagactcctagagcagtgtgcacctccttaataaaagggtgcaagggcagccgtaagccatgctccaagtgggctaggtatagcggcacttgatcctcgccatggcaatatactggctcgcttatctctggcgccaccaatgtaagagtttgagagatattgtattgatcatacaaccccaacagattatccatatggaccttcgagctgataagtagaagaacagcgagtctctcctcactacggccagagtttgaaacttgagaggccatggaagactttttcttaaaaaatcttggaggaatattaggaatttgtcaaagcaaaggttcgtaaaagaattatcttgacattaagaggctatttataagctttcaaggaagagtatagaggaatttcaaaggatgcggtgattttcgaggcaaccaggcccgatccacttcggaatctgaagcggttcactcaaaacatgaaacgtcaccctcatttaatgccccacgtcccattacaataaaagcgaaagatgctccattatgtccgcgacacttcatctcctaaaaagaaggttcagatctttgataacatcagctctgaaaagcagagtcaacaatggatgctcgataaagacttctcattttttcgtcctcagcaggcttgtattgatcagaacatatcttatttctctcagagctgactaaaagtcgactccaagtgaaaggggcaactgttatggtgttcactcacccaagatatgggcatttacaaaatgatataataagagtcctaacaaaataacctcaaacccacttgagtggcccaagcccaacggaggcctcgacctcgccaactcatcaagtcgaccttattttatgccaacatgaaaggtgggattagtcgaccctatcaccgagggcgacccacttagagcactcgaccactcactgggtaattctcggagatgacttgagggacattccctactgtcgactaagttaaagactcggcccaagcctaaagcctctccccagagcatatgttaatatttcaatccatgtcagacaaaccttatccagattttagcctaatgatctatgtgacttgtcagctgcccaagtgccgaagtgacttctcctctagtcgccagtcgacacctataaagcgagggacgattcaagtatgcacacgtgccttctgccgcaccatcaatcacttcccgaaaaatgtggagacaccctctcctgtgccgaagtgacttcccctccagtcgtcagtcaacacctgtaaagcgagagatgactcaccttccagctcacactttgccaccattattttcatgactgaattgaccaatctacccttaacatcctatttatatacagatgctattcaccatagctggagagaggaggttcataacctaaaaccccccaaaagcatacatggcagaaaaacaagaacacacagttctttgtctagacaaaggagctcatgtagatcctctggcagagacattgccactttaagaaccatattggttcctgaccttcccttttcccactcaagtttcactaactttaccgtcgaaggaaccatgggggaaccggtccctgccctcttacgactcttttgtgtgcagattgctcggccatcctaattctaaaactaggcataaagtcgaagaagaaagcggcctccttttttttataaactatgaaaatcaatcccctgttcaagaactaggaataaagtcgaagaaggtagtggcccctccattactctcccttaccacgtcccggtgaggactcaaaggagaccgatccagttccggaccagaatcaatcccagcctagatctaattggatgtgtgatatttaacatcaacaataactattctctaaactctttctctatttattacctttgcatttaatttgattggtgtgttgcattggcaaattttaattgcacatttattttcacattaccctattcacccccctctaagataatttcacttgtcaccataaggctcaaccttcaccagcatgtgacttacaacatctcgcatgggaccaccactaaggagttgatgaaggccttggaggcattgtatgagaagttgtctgcctcaaataaggtgtacctaatgaagaagctattcaatctaaagatgcagcaaggagctcgcgtagcggacttcttaaacgaattttaggctgtggtgcaacagcttgctgcaatggatctcaagtttaacaataagatccaagctcttctgctactttcttgtctaccaaattcatgggagaatatggtgatggcggtgagcaatgccaatggcaatgacaagatgaagctcgacacggtgattggggcaattctagatgaagaatctcgccgcaaagtcttaggagttgagacctctagcattgggagtgctctgcatgtcgaggcaagagggcgtgcacagaagaagggtaggggatgacgaggctggtcaaagtccagaggaaagtttaaagggtcggacccgaatggttacggtgaaggaaagtgctttatatgtggaaagaagggtcactttgtaggggactacagagcttttgttctagcatcagaaagggatgatcaggctgacggtgcagccaattttatgcacgagacaaatttggatgcacttcttctatctcttgaagataagaacgatgtgtgggtcatcaactctggcgcatctttccatgcaacctcacaacaaaagctgctttcatcgttcatgaagaaggacttggggatagtctatcttggtgatgatcaaccttgcaaggtctccagaaaggaaaattgtaccctcaagatggagggcgggaccaccttgacgctgaacaacgttcagcgtgtaccaaatctcaggtagaatcttatatcagtcgggaaactgactaactctggtttcagattatccttcaagcagggaagctggaaggtgtccaagggtgccctggtggtagcatacggcaaacgcgaggggtctctctacatcaccaatgggaagatcagccgcttgcttgctgcaggacaagcatcatcatcatccgccgactacatgactttgtaggtcgtaaaaaaaatgattgattgattccttcaactgtattagctttggagaaaatactctattggttagtaagagtctcgttacaatcactctttagtcgattatagaagaggagaagattggttcgacttctcctttgtttaatatggattctgggtggcgaaaggatgcctcactcgatgcttgagtcgagcttgcttcccattgattatcagaacaagaatgcatggtcaagtacttgagccgctgtcggtagctactactgattcttaaccacaagaacctaggtttggatcttcaagctcgagtgcaagagctctgccaagccatggccagaaaaaaaaagtatgtccttcataattgatcatggctacttataggccttagctcgtaactgatgcgctgaaatcgtggagtcatggcataactgactccctaaatttagcccacatgggctgactaggtcaacaagaccgttatagtctagcttcatacggtatgacgtgcctcactgcattgtgaggttcctctgataagacaagccttgatacgcagcgaggttcgtctaacagagtgaactttgctatgagatgaactttgtcttttgaaatagctttgtcttcactgacgagcttcatccttaatggttgagtccaattgcgtgatgagccttgtggacttcttctgatgaacttcgtcttcactgacgagcttcgtcttcactgacgagcttcgtcttcaataatgagttttatcttcactgacgagcttgagttttttcttcattaacgagcttcggactttgtctccaatgacaagcttcattgtttaagacgaggtttgtcatagtaatgaccctcgtcatgcttgtggtgagctttgatgctcctttgatttttggtagttttttagtgcctacaagacctccttcaaagttttcagacctgaattaggttgcatggggtctgaaatactttgaaccccttctgattaccatgagtttggttcgtatgatgaacttgctctcttggttagcttcaacgcttcagaatgaaccttgcgattcgccatttctaggtgagcttggacgcttcgaaacgaggctcgacattctgttgaatctcaccactccatatgagctttgtcaggcccatgttggtctgacaattcattttgtcagcattaaatgcaatggtctccatcatcgcaccttttctaggcctgataggtggtcgccagctagcactctgaaatttgttctgcggatttcgtctacaaatcttgtctgttacagatttcatctacagatcttggccgtagatctcggccactgatttgattttttttctacctataaataagcgtccgcctttgacgaaatttttttcgtcttcttcaaacatttgaaccctaggtgcttcgtctgcatagattctttgcctttgattttttcacaagacttcgcactgatggccccaaaaatcaccgctggcaaaagcaaaggcaaaagggcctctagctcccatcgctttgcctattttctcaggtattgcaatcgaacgcaagttttacattttagaactatcaaactctgcctatttcaggcttgagtcttcgaggaagatgaacagtttccttttttttgagacaaagcttgtttgacggatgagatttgtttgttaggcgaggcttgtcgatctgatgagtctcgtcttttctaacgaggcttgtctgttggatgatgttcgtctgtcaaacgaagttggtctgtctagcaacattcatctatttaacgaggttcgtcttgatggatgaggttcatctgtcaaacaaagttcgccagtctgatgaggcttgtgccattctttgggtgaatttttttagccaatgtcccacctatcttacttgtttgggctaaccttattgatttgtcctttgcagttttgcattctcttactccgattcctccacgtggtgacatcgggtcggataatactcagacaagaacggaccattctcattatcccatgtttgagaatcttctcgtattccaaaaccgaagtcaagaagaatttcacttactctctgagccctcaagtgtcacactaaggcatttgatcatagacgcttctttaaaaacagctgaccaaagccacatgtcaaaacctatttgttggatagcagggtcctaatctattttggtaacaggttattaggattcctaatctattttggtaacatgaggttattaggattcctaatcttttttggtaatatgattcttaatctgttttggtaataggttattaggattcctaatttgttttgtttttggttttaggattcttagtctgttttggttttaggttttctatatatatggaacgccttagaagagattaggatcaatcaaaaagaggagagttgtaatcagagattagagagacttttgagcattgtgagagggagatattgtgagcaagttgagagctttggttgagggttagtttgtgagttttgtgagattgtaaccctttgtactctgtttgatttagtggaatctccccatcctctccccgtggacgtaggcaaattgccgaaccacgtatatctctgtgtttggtttgatttgttgtatttggattgtgctcgtgtgtgattggttattcttctctcatgcttacgacttgtttggtgagcgagcacgcttctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatcggtcgaccggcacggtcgatcgatttgaaaatcgagatttcggtcgaccgtaccggtcgaccgacgacctctctggaaaatagtgaggaaaggcgatgggagcggtcgaccggaccggtcgaccgctttctgacattttgcagaaaacagtttttgaccaactttaaatatttgcaaaatatttatttgacctctgaaaaatctgaaactttgtaaaatgtttttaatactaaaaacaaactgtttggaaaaagaattttgtagataggtcctcatacttgtgaaaaatagtattttgtgaaaaacgcttaaaattataagtatgaaatcgtgtgtgtgattcccaatagcttcaagtaaacttagtaactctttgcctacattctagcactagagagggaaacaaaagaaagctaatatcctcatatagagagcaatacttgagctttgatatagcttgaatcggataaagcttttagtcgaatttgacgttcttgaaataacgttgcttcatctcttggcctcctcctcctttggatatcttcgttgtagcgtatattccatccatcctccgttaatggcactaacgagcttgataaatgaatttgctacattttcactcaataagctattagtaccgataatggtggttgtaaaacatcatcaaaacataagggctaacaatcttccccttttttatgatgacaaccaaccattatataagagcaaaaataaaatagcttatagataggtgctccccctatctatgagctccccctaaatatatgcaacaaatgaggagatttctctccccctttgtcaccatcaaaaatggggaaagaaatgcaaaatgcaagatgcaactaaacaagcaagcaatgtagaactttcacatagtgcataagcccaaaccatttcttatgcgacaaaaatcatcctctccaagaggcttagtaaatatatccgctagttgagattttgtgtcaacaaacactagggatacatcttgtcgctctacatgatcgcgtaagaaatgatggcgtacatcaatatgtttagttctagaatgcaaaaccgaatttttggaaatatttatagcacttgtgttatcacaaaagattttaatattttgaaaattcaaatcatagtcaactaaactttgtttcatccataaaacttgagcacaacataagccggcggcaatgtattccgcttccgtagtggacaatgcaacacaattttgtttcttggaagcccaagaaacaagggaatttcctaagaattggcatgttccactagtactcttgcgatctaccttacatccggcaaagtcggcatcacaaaaaccatataaatcaaaagaagtgcttcttggataaaataaaccaaggttaaaagttccattaacatacttaatgattcttttaaccgcaattaaatgagatgcttttggagatgcttgaaaacgtgcacatgcacacacactaaacatgatgtcgggtctactagcggtgagataaagaagactacctatcatacctcgatatagtttttggtctacatcttcaccactctcatccgcatcaagcttaacactagtactcatgggagtaggcgcatgcttagaattctccaacttgaatttcttcaccaattccttcgcatacttgctttgtgaaatgaagatcccatccttagtttgcttgacttggagcccgagaaagaatgtaagctctcccatcatactcatctcaaagtgatcctgcattactttagagaattccttgcacaaggattcattagtagcaccgaaaataatgtcatccacatatatttgaactaaaatgaaatcatttttcctttttctcacaaaaagtgtgttatcaattgttccttttgaaaaatcattttcaataagaaaactagagaggcgagcataccaagctctaggagcttgtttcaacccatataaagctttttgtacccggtaaacatgattaggaaaagcatgatctataaaaccggggggttgctcaacatacacttcctcttctataaagccatttaagaaggcacttttaacatccatttgaaaaagtttgaaattttaaaagctagcaaatgccaaaaacatcctaatagattctaaccttgcaaccggtgcaaaggtttcatcatagtctatgccctcctcttgattgtatccttgggcaaccaaacgagctttatttctagtaacaatgtcatgttcatcaagtttgtttctaaaaacccattttgtaccaattacactagcattgttaggtctaggaactaacttccaaacttcatttctttgaaaattatttagttcttcatgcatagccaaaacccaaaactcatcatttaaagcatcattaatctttttaggttctagttgagatagaaatgcaacattaccacattcactcaaggcttttgagcgagttataactccttttgaagggctcccaatgatttgttcctttggatggtttgatgtgaatttccaagctttaggtggttcaacttgttcttgagcattggtgctatctacatccttttgaacttctatagagggagtgtcattgatttgcaacaagtccaatcctccctcaatatcatcatcatcatctttcctaggcaacacaacttgagagccaacattagtctcatcaaaagtaacgtttatagactcttcaacaacgaggcttcgtttattaaagaccctataagccttacttcgaggtgcataacccaagaaaataccaacatcaattttggaatcaaatttatcatggtgatcttttgtatttaaaataaagcatttgcaaccaaagacacgaaaataaccaatgaaaggagtttttccataatagagttcataaggagttttcttaagctttggtctaatcaaaacacgatttaaaacatggcaagccgtattgacggcttccgcccaaaaatattttggtaaatcaaatgagtttaacatagtgcgtgccatctcttgtatggtgcgatttttccgttcaacaacaccattttgttgtggtgttctaggagcggaaaacatatgagttataccatgatgagcacaaaaatcatagaaaaattcattttgaaattcaccaccatgatcacttcttattttaacaactttcaaatccttttcatttttaattcttttaacatgattagcaaattcttcaaaacaatcatttttctttgcaagaaatattatccatgtaaaacgagaaaaatcatcaataatcacaaaaacatagtgtttgcctccaagagaggtaacacgcataggaccaaataaatcaagatgaagtaattgcaagggtttagaagtcgatacctcatggatggatttaaaagaagactttgtttgtttacctttggcacaatcctcacaaattgtatcttttatgaagtgcaagctaggtagccctttcacaagattcttcttagacaattttgatattaactccatatttgcatgccgcaagacacttcacatcttgattcactaactcattcatcttaaaaatgtaaacattagacttgcgatttgcaataaaaataatttttccatccatactaatgatgcatttatccggtttaaaagaaatatcaaaacctttatcacttaattggctaatgctaagaagattatgattcaagccatttactaaataaacatcttcaataatgggtgagggtttcttaacaatagaaccgataccaataattttacctttctcaccaccaccgaaggagacattgcctccttcaatccttgatagggttgcaaataactctttgttgcccgtcatatgatgtgagcaaccactatcaaggtaccacatctccttacgtcgttgccgtgacgttccttacaaaagaagaagatgaaggtgtagtagctttaggtacccatgtcttgggtccttggtggttagtagtcttggtacctttgggtacccatatcaatccataaaaatcatggttatctttaattctacaatgagtagaaatgtgtccatgtctcatacaataggtgcatacaaaatttcttttgtatgtacgaatgttagaaccacgaaacctatttctaccatgatgattgtagttggcataagcgtgagtgggtctagtcctaaaaccctcaatttctagtcttttaatctttgatcttaattgcttgttctcaaaatcgagatctccaagcaattcatcttttagagcaagagaggttgttagttgttctagcttaatatcacaagaggcatgcaaatttttgaaagaagagtattctttagacattcttttaaattcaaagttcaactcttctaaagccatagctatgtcacattgcatataaaaagattcactttcggcctcggnatattacctcatcttcatttgccatgaaacaaacatttgggttatgaagagcaagtttggctccttcttcatcactatccgagtcacttggttcggattcttcccatccggcatacatagccttcttcttcttgtacttcatgtacttttctttgagcttggggcaatccttagcgatgtgacccggttcattgcactcaaaacatttacctacacgagaggaaaacttgttgttagatcgagggttaaattttttgttcactttttataagtctagagattcttctagagagatgagccacttctctagaaaaatcaacttcactctccgacgacgaagatgagttgtcactagctcctttgagagctatggtcttcaactttggtgacggctcctcaacttctcgtgatggcacttcctccttctccttccccttgagcttcttctcatgcactttgagctttccgatgagactatcaagagctaaggtagtgaggtcatgagcttcctcaatggccgtagccttgggctcccatgccggagtcaatgagcgaagtatcttgtagttcatctcttgaatggataattgcttatctagaccatgtaattcattgatgatattagtaaaacgggaaaacatagcatcaatggattcatttggaagcattttaaatagctcataatcatgcatgagtccactaatcttagattccttaacttggggtgttcctttatgtgtgacacataatttttgccaaatttcgtatgcggttgcacacgtggaaaccctattgtattcatttggggaaagaccacatattaaggcgttcatggccttagcattgagattggcaaggtgcctttcatcatcggacatgttctcaattttggacttctctacatatttcttttctatgagccctaggatgtcaagatcaatgcaacgaaggtaaattctcattctagccttccaataagcaaaattagtccctgtgaagagtggtggtctagttgtggattgtccttctaacatatgcatattcaaagaggcctccattagatcttttctctaaggtgattaaactaaaaattaatatagagaccaagctctgataccaattgttggaccctagagggggggtgattagggtcaagaggctctaatatgcaatataaattcagcacaagcaagacacaaaacaaaaatgcgataaaagtaagagagatagggttaggagttcgttatccttgacgcgcgatgtgttaacgaggttcggccctctggcctacgtccccgctccccactctcgaggagaaatccactacacacccggtttggaagccggaacttcgtctacacagcgatctccacagatctctttcactacacagtttgatctcaacagatcacactccctcacagtagatcttcacagatctcactaatcacagcagaagaaaagatgcaagaacctctctttacacagcccctatagcaaagagaaggtttactgaagctgggaagtgaaacacacttaaaacagagagaaaacaggctttgaaaatttttctcaggaaacagaacgctctctctggtttttgcaaacgttagggctaaaaagaagaagaagtctggggggtttttatagaagagtttaaatcattttaaaacaaaaccctatcttcccaaatgagcaagtaatctccttttcagactcccagcccagactgtgccaatcaccattaagtgaaagcacagtgatcaaggcagaagaccgttttaaaaaagtcgcggttgactgaaggaaatttcggtcgtccgaaataaaccttcggtcgaccgaaaaatcacgtcggtcgaccgaccgaaaaattcggtcgaccgcgagctgcttcgaaaacttggaaaacaaacagaaccantcgtcggtcgaccggcacggtcgaccgatttgaaaatcaagatttcggtcgaccgtaccggtcaaccgacgacctctctggaaaatagtgaggaaaggcgatgggagcggtcgaccggaccggtcgaccgctttctgacattttgcagaaaacagtttttgaccaactttaaatatttgcaaaatatttatttgacctctgaaaaatctgaaactttgtaaaatgtttttaatactaaaaacaaactgtttggaaaaagaattttgcagataggtcctcatacttgtgaaaaatagtattttgtgaaaaacgcttaaaaacataagtatgaaatcgtgtgtgtgattcccaatagcttcaagtaaacttagtaactctttgcctacattctagcactagagagggaaacaaaagaaagctaatatcctcatatagagagcaatacttgagctttgatatagcttgaatcggaagaagcttttagtcgaatttgacgttcttgaaataacgttgcttcatctcttggcctcctcctcctttggatatcttcgttgtagcgtatattccatccatcctccgttaatggcactaacgagcttgataaatgaatttgctacattttcactcaataaactattagtaccgataatggtggttgtaaaatatcatcaaaacataagggctaacactgtgagcactgtgttcttggcaagaagacgaaggtgaagtttgggacagtcattcataggacgagaggcatcctggattatgtgcacacagatgtttgggtcccaccaagactgcatcacttggtggtagatatcggtttgtcatgtttgttgatgactattctaagcgttgttgggagtacaccatggtgaagaagagtaaagtcctagatatatttgtggagtgaaagaagaggttggaactccagactgggagaaagatcaagacgttacgatccgataacggtgatgagtacacatcagacccctttcagcagttatgtcgagacgagggcatagagagacacttcacagttagtcaaacaccacagtagaatggggtagcagagaggttaaatcggtctttgttggagaagatacgatgtttgttggcacatagtagtttggagaagatcttttgggctgaggcctttcatatgcaagccacctcattaacaggatgccttcatctgcgattgaggggaagacccctatggagatgtgatcgggagagccagcacacgattatgactagctcaaggtatttgggtgccctgcatactatcatgtgaagactaataagttggaacctcgagctaggaaggtcatatttataggattcaagcttggtgtcaagggatacaagctttgagatccagttgataggaagattgtgctaaggagagatatcacgttcgatgagtgttgggtcaaaaaattgatgttgggattgattttcttgttttaagaaataggttcaatcacttggtacgaaacccttacaatcactcacgctctctctcgattacagatgaagagaagattaattcatcttctcttttgtttaacgtgggttctaggtggtgatgcggcataattatgtaccaaaattgcaagtgcacaattgatcaagttatagtataaaaagttatcgatcccacgaggaagatgattttaagagattattagaattggttcttatgttttatgcncttctctttttatcataattcaacttagatttattaagtatagactatcaaaccatttaaggaaagtataacctatcaaattatcatctaagttaaaattactattcatgataagaacaacaataagataataatcctagaattcataagcataacctatcaaaccatttaagataagtatagattatcaaattcttcttctaccgattagttctctagttgattatcctaaacatgaacattttaagtgaaagagaaaaattcatacaatataaaggaaattagactagttttatgcaattctaagattcctacaagaattaatttcacatcttaagaaataaaaaaaaagaagaaaaaagaactaattacaaaaataaaaagaaaagaaaaatctaaacaatgaacaagaaataaatctaactacaaagaataaaaatctaaaagacaaaataaattacagaaattaaatgcaagaaaataaatctactctacaaaataaagtacaaaaagaaataaaaagacaagaaaataaatctacactacaagcataaatgtaaatctaactaataagcaataataaagaaattactaaaaagaaataaaaaaagaaaaataaaagaaatacaaaccttcaaattgctcttcatctccatcctcatcattcaacaaagaggagaaaagaaaatttaaagaggagaaaaattactattattaattgcaataaaagttacaatttttggaaggccttctcaattaagagtagccctcctctccaaatagagttacaaaatttttcacacccttaacccctcactctctacccctatttatagtaaacatcagtgaatgagagccattggattgaaatcttatccaaaaataacaaatttcagccttagatctataacaaactgtacgatggcatcgatgcaggcatcgatacaagcatcgatgcaggcatcaatacaggcatcgatgcaggcatcgatgcctaccttcttctggttgctgtccgcagaactcttgtatttggcttttgggcttgtatcttgggctttggcttagacttttgggcttggcattttctcttgattttccattgggctttgaattatttcttcattaaatatttgaaagaattcctttggcttcatgggcttcatttctttattaaatcgagggctttttgttgagagatgagagtttgggctcttattcttcattaacctacaattaaagataaaagcaattgttagtggtatatttattcatataaaatagataatgagggtataaaattgtaataaaatgtgattatcaaatacccccacacctaaacttttgctagtcctctagcaaagaaaataaaaagaaaatcctaactcactttcgcaggaatcgaggttgtatttagcgcatacaactagcctttaaacccctaggttaccctagtggacgagttgtagtctcgtgagggtttgcggtgatatacccataaaattcggtcaacttgccaagttaaataagtcagtaaataacagattttccttgatatatttaaacattctaattgaagctagttaataatcaagaaaacgtttttatatataactccaatgtaaatcccctagaaaatctttttcattatagcaatacaaaaccaagtcaaatcttagaaatttaattaaaaagttttgaaaagaacatgccaactctttgttttaaataactttcaagtctcttgatcaaaaattgtttttcaagaccatatatacaaaacaacaatatatatatataaacaatggttagtgttatatatattttttttttcactctctaattcttggtgattgttttctattttaacgggctttctaagtgaccatttaatgagttttgggccaatgaatcccaacccaattgggcttaggtcatgaagtatagagatactccttgggcttaattactcagtcaacttaggctttataagatagaatcaccttgaatttaagagttttttttttgtgcccattttttgcactcttcttttataaggttagttttttttatatatgtgtgtaagtatatatagtctgaaaaaagtgtgtaaatcaagataacttgaaaaaaaatattttcaactctgagttaagcatggaaaaattttattatttttaattaaaaaatctaagataagacttaagtaaagtatactacttgaaaaattatttcttaagaattttatttggagttataataaaaggtgaacttgagtatgtcactaactaaggattagaaaatttaaaatctatcaattagatcaattattacttaactctattaatttggtaagtgaaaaaaaaaattttaaactaacaaaagataaatgctgagagagaaaaaaactgaaacaaaatactaattagaaaaatataaacaaaagctaactagcttatacccccatacccagactttgcagtgtcctcaaggcaaataatatctagaatatcacagtttaataagtacatgccgaaataaaaatcaaagacagggtaaaataaaaagaacatccctcactgctcatctcctgatatatcgtcatccacatcatcagcggcagctgctgaactcggtcccgcctcatcctctcttgggaaatcatctggctgaaatggtgtgatataactatgaagctcaggtagaggtccatctgtatctccatgttctctctgccatcctctcaccaaatatgccagggtatcagtggagtatctcatctgaccatgtatctcgtgtatattccgctgcatcctgtgcatctgtatctgcatcctatccatgtgactccgcattctgtccatctcctctcgaataggatcctgtgtaactggctggtgctgaggaggctctctacctgaaggaccggactgatctcgccctgaaatgctcctcctcacagtctgatcatttagtaaccccttccctccttctaacctatcctctgcgaacactggaacgtgaaatctatggcagagtttagtgataaaataggggtaaatgagctgagtacgtgatgcagactgtgttctgacccaatccaacacattctccactgatgagcgcatacatacaaatataatcctcgctatatcaaatcgcaaaccagtggctatccaaaagagaaggagaatatcgtgtggggtaatgacagagtatgtagtggtgggtttcaaatcaaagttcaggaaaagattaagtaatctatattctggtttgagatttcctgaaccgaaactagatgtaaagatcctcccacacaaggttgcagacatgttgttgtattctagtgtaccaggctgtaatgtggaggctaaatggaagtaatctggtacatcagtgggtggttctgcaaggtcaagggtagcacggatagtggaaagatcgaaaataaccctaacacccctcacgatagaaaaagctgaaaattctctatctggattaatttcccatccagaatagaactcatgcactaatgaaatgtttgctttttctaagggtttagtcatcatgctcctaagacctactgcagttaacatggtgactgtggaatgatatgtatgtaatgcactcatctgaaatcccctctcaaaatgaatgttaagacccataattttggctaaaatagtgggtctatctatgtcggtatcagatggatcagaagatgatgaagttgctcgaaatttctttctgggggcatctacagaaaaagaaagaaaagaaaaaaatttaataacaaaattccaatattattatttacttattattatttttatttttattttttgacaagaatttagctacaaattgttcaacatgagttaatttcaagttatcagaattttgttttgacaaaaaatttcctcaaaattgttcttttagaacaacaatgttaaaattttgataacttgatcgatgaaatccacatgttgatattacaattataagctaaaccttaattttttttttggaattgtttgcacataacaccctaaattcaagttttttttttgaaatcacgtactcaattgaatgttcaaaaagtatttgtttttgcacaaaaaccctaagaattttcgggtttgcatgaaacaccccaaattttttcggttttgcacaaaacaccccaaaatattttttttttcaaatttttgtacaagatatcctcaattgagttctaagttcaaaccccctagaaattttcgaattttgcataaatccccccaatatttcggattttttttttttgaacaaaatccccaaattttggcaaatccccaaattaaaccctaaatttactaaattgatcatgaatcaacacaaaatatgataatcattcacaactacctatgattcaatcaccaaatcatccatgtattcataaaaattataagatcaagttagaaacaatacattgggtagatgagtggaggtggaagaaggccaaaaatagtgaagaaatctcctccttgtgatcttgatcttgtgtgggggggattagggtttgagggggaaaaaaatcgggtttgggagttgaaagaaagaggagaagaaagtggcttggggtggggctgcggttttaaaagctgctgggtggaggcatcgatgcgggcatcgatgcgggcatcgatgccccgaaccatggtgtttgggccagccggcccaaacacggtttctttaattttttttcttttgggcctgatttgtgggccaacacttattttatctttttatttttcttttttttttgttaggcctatgttacttattcaaattttgttgttttgttttgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgaggaaatatgtatatatatgtcttttttttgaatttttttttttacagataatgaggttcatgaagaaccaacacctcttcctcttcgaacgtaaaaaattctaaaaatggtttcagacgttgaccatttgttttaaaaatgttaccatttttaggattttctatctcgacagccccatgcgaaaaaacttgtttgataaaaaatggacctgtccatcttgatcttaattttctaggaaaaagatgtaattttgaattatacaataaaactttctgtcctggagagaattttttttttttgtaaaattgatttatcatgaaaaattttggttttctctttgtaaatttttgagtttatgtatgcatcatttctaatttcttccaactcatttatttggagcaatctgttcttacttgccgagtctgagttaaaatttaactgttttattgcccacattgctcgatgctccaactccactggtaggtgacaagcttttccaaacactagtctgtatggtgacatccccaaattggccttgaaagctattctatacgcccacagagcatcacataattttacagaccaatcttttctgttatgattaactgttttttctaagatttttttgatctgcctgtttgtgacctctaagtttgagcccgtgcgctgtgccggcattactaacccctaagaaagatggttcatggagaatgtgtgttgatagtcgagcaatcaataagatcaccgtgaaatatcggtttcctattcccagactagatgatatgttagatatgatgtctggagccaccatattttccaaaattgatttaaagagtggctaccatcaaattaggattcgtctaggggatgagtggaagacagcttttaagacgaaagatggtctatacgagtggatggtcatgccttttgggttgacaaatgctcccagcaccttcatgcgagttatgactcaggtactacgaccttttatgggtaaatttttggtcgtttactttgatgatatcttaatttatagtaaatcgttggagcatcatattgaccatcttagtcaagtctgtctcactttgaggaaagagaagttatttgcaaatcccaagaaatgtgttttcatgactgaccaagttatatttttgggatttgttgtgtcttctcaaggagtttctgctgaccctcaaaaggttcaggcaattgtagagtggcccgagccccggagtatccgagatgtaagaagttttcatgggctcgcaactttctacagacgatttatcaaggagtttagtgctatcatggccccaattacggattgcctaaaaaaagaggaatttcgttggtccgaagaagctgccacggctttcaaagaaattaagcagcgaatgaccgatgcacctgttatgagacttcctgatttctctaaggtatttgaggtcgcgtgtgacgcctcgggcattggtataggtggagtattgagccaggagaagcaccccattgcttactttagtgcaaaacttagtggtgctaagctgaactactctacctacgataaggagttctatgcggttgtacaatcattgcgccattggcgacattatcttttaccacaagaatttgttatttattcggaccatgaagcccttcggtatcttaactctcagaagaaactcaatgccaggcgtgctcgatgggttgaatttctacaagactacacttataccctcaaacacatggctggagttgagaacaaggtggctgatgcactcagtcgttgagcttgtcttctaaaccgcatgagtgcagaggtagtgggcttcgaaagaatcaaaggggagtatgaatcatgccccgactttggagagatttttgtttctttaaaaggagtgacttccgagatagatggctttttgttccaagatggctatttatttcgatttcgcaagttatgcattccgcgtacttctttaagagattatcttgtttgggaattgcatgcaggaggccttgctggtcattttggtcatgaaaagactatagaggcggtagaaactttgttttactggccaagccttaaaagagatgttgcaaagttaataggacaatgtcgcacttgccaattagcgaagcaacgtaaacaaaatactggcctatacacacctctccctgttccagatcgtccttggcaggatgtaagtatggatttcgtgttgggacttcctaaaactatcagaaaacatgactccatttttgtagttgtggatcgcttttcaaagatggcccacttcttgccatgcaacaaaacgtctgatgcatccaaaattgctcggatctactttgatggtgtggtcaaattgcatggtttgcccaaaaccattgtatcagacagggatgtaaagtttatgagttatttttggaaaactctatggcacaagatgggaactaaacttcagtattcgtctgcttttcatccccaaactgatggtcaaactcaggtagttaataggagtctaggcaatcttttgcgctgtttggttggtgagaatttaagaaattgggatcttctgttatccactgcagagtttgcatacaatagctcagtcaataggtctgtaggcatgagtccatttgaagttgtgcatggttacaagcctaggaagcctatagaccttattcccatgtcgcatcatcctagggtgtccgagtcagcagttgcatttgcatcacacattcatgatttgcatcaagaaatcaacaagaaaattcaagaaagcaatgaacaatataaatctcatgctgatttacatagaagacatcttgagtttaacgaaggtgattatgtaatgatccgaattcgcccagaacggtttcctcctggagccgtcaagaaattacatgctcgtagtgctggaccttttaagattatcaagaaaattaactcaaatgcttatgtaatcgatttacctccagattttggaattagttcgacatttaatattgcagatttggtagcttataaaggtcctccttttaaccctgaaaatccacttgtggatcttgatgagcctacccctgatcctttccttgagggacccccattgccaccactgcctactacttttgtcccatttacagctgaacagattgatagcattcgggatgatcaaatcatctcaacccgagatggtggttgcagacgatatctagtacgttggaaagatcgtcctgaatctgatgatacatggattactcgtgaggacctacagcgcctggctccggatctattggagtattatgagggccagttggagcctaactcgacggggtcgagttcttcccaccccgggggaattgatgaggacatcgcacagcctccacttcgcacatattttcgccgccgtcgtcgtcttgcttcagcttatatttggttttgattttgagaaggcttggagtctagctagtgttacgtttattctctttattgtatttgctctttttttagtcccacatcggatatgggagtgaacttgtagttgttgaaggcctatttaaagaggtcaattctatggaataaatcaatgaatatttgaagaaaatttcgtttcatttgtgaaactttgggtaattgatttgatctctaagattgagtcaatggtggtgaagccaaggcccgggttgcgattcgtggtcatatcttgttaatctttcaaaccctagttttccccaaatctttgttcttccccaaatttcccaaatcccttacataaaaccctaaaagtcccatcgtcccgcatcaacttgtccactgctttgggggtgataaggagttgacaatttgtgtgtgattgaatattttctcatcaaagcttcgaaagaacggttacagaaatgtgtaccgttatcactgatgatcgctcggggtactccaaaccgtgcaaaaatgttctctttcaaaaacttgacaacgaccttgtttttattagttttgcaagctaccgcctcaacccattttgacatgtattcaacggctactagaaagtaaacatttccaaaggaatttggaaatggtcccatgaaatcgataccccacagatcaaaaagttcaacagataagatgggttgtaagggcatcatatttcttctagtgaccttccctaaaagctgacagcggttagagttttgcaaaactcgaatgaatccttgaagagagtaggccaatacagcccagattgaagaacttttttagctgtttttctcgggccaaagtggcccccacatgcttgctcatggcaaaatgatagaacactcctagtttcttcagtgggaacacacctcctaaagatatgatcagaacagtatttgaacagatatggatcatcccagtaaaagtattttacttaggagagaaaacatgatctatcctgtttggaccaatgagaagggatctggttcatgactatgtaattcacaatgtcagtgaaccatggaacagattggatttgtaggagttgttcatcagggaaatgctcattgatcagaacggttaatgttggtgcgttctgtagtcgagaaaggtgatctgctacggggttctctgtttcccttctgtcaagaatttggatgtcaaactcttgaagaaggagaatccatctaatgagccgtgctttagcattctttttggtcaaaatatactttactgcggcatgatctgtgaaaactttggttaagaaaccgatgaggtaggacctgaatttttctaaggcaaagactacagctaaaaactctttttctgtgacagaataattttgttgggcatcattcagattcctactggcgtagtagatcacatgcggtttttcgttaaactgttgtcctaaaacagctccaatcgcaaaatcagatgcatcacacatcagttcgaagggtaagatctagtctggtgcatgaatgataggagctgtggttagctcctttttcagatattcgaaagctttgaggcagtcgggggagaagacaaatgatcgatgtatccttagctaagagattggtcaagggtctagcaattttgctaaaatccttgatgaaacgtcggtaaaaaccagcatgaccaagaaacgatctgacatctttgacagttttgggaggagggagattagaaatgagatctaccttagctttgtccacttcaattcccctattggaaactacatgtcctaagacaatgccttgtttgaccatgaaatgacatttctcccaattgagagtcagatttttctccctacaccgttctaagaccaatttaagatgatgcaaacattgggaaaatgtgtcaccaaagatggaaaagtcatccacgaaaattttgagaaatcgctctaccatgtcgaaaaaaatactgatcatgcaacgttggaatgtggccggtacgttacacagtccaaagggcatgcatcggtttaagttatcctacacctagctgttgatagaccgaataaggaaggaggttgacgctggcttccaagtctagaagtgccttatcaatgtgagtgttatctatgacgcatggaattgtgggacaaccagggtccttgtatttcaacggcatgggttttgaaaaaatttcactaaggttggcagctaagaagactttcttggggacgttggtgattcttttcttagtgcataagtccttcaagaactttgcataagaagggatttgtttgattgcatctaggagagggatgttgatcttgacatgtttaaatgtttctaggattttctcaacctgcggggagttttttctaggtttgagtctatctggaaagggggcaacgggcctatacctatctagatcaggttcaatctcaagttcagcgctttggtcatcggaaggaattgcttcatcagaaggagtttgttggatgggagaaggggtttgatccggtggcattctaacttggttgtctatttgttttcctgatcgcagtgtgtgaactacattcaattaagctggattgttggaactggatccagtgtctttagggtttgtaacaggttgacttaggaattttcctttttctctctcacttacggtagtggctagttgcccaagttgggtttctaaccgagctatggcttgagtgtttgagtttagcacttggccggttgtttgcatgaaagaatttagagtggtggatgaatgggtcaacatgttggtcgtttgtgtagaagctttgatcataacttctaaacccttttctaagacactcaaatgtttgtcatgatcagaatttgaaggatttgtaggctggtgaggatgaggatgttggtttggaaaaatagggttagctttttgaaaattgtttggtgcgttgaatgggacagtgtttcccctagggaattgttggttcgacgcgggaatgaagttttggtttccatgagaatttccttggttccaagcaaagttaggatgatttctccaacctggattgtaggttggagaaaatggatcatttctagggtgctggaatgcagcgttcatttgttctaaagcatggttgtttcctaggagagggcattcctctgaaacatgggtagaagactgacagttatgacatcccggggcaaaaatatgattgatttgagctggagctcgctccttaacttctaaggcttctaacctccgcagaattgtcgccatctttgcttcagaagcaatgtttgactccagggaaagaccactagacttagattgggaaacagataaaaccctatcatcatagtttttccactgcattgttttctcggatagactctctaggaattcccaagcttcatcggcgtttttcctcataaaatctccctgacacatcgattctaaagatgtttttgaagaatagtccaatccttcatatatgacttggcacagtcaccatttttctagaccgtgatgaggacattggattaaaagatctttaaatcggtcaaaatatttccagaatggctccgctgggacaattttgaagttttgaatactgttcctaagctttaccgttttatgaatagggaaaatttttttaagaaaaacggtgacaaattcctcccaagttgagatagaatttatcggtaagctgtacagctattttttaggtttgtccttaagagcaaatggaataaatctaaggttaatcgcatcttcagttaattctctcattttaatcataatacatacttcctcaaattccgatataaatatatatgcatcttctgtttcattaccaaggaatttgggaagcatgtttatgtaatgcggtctaagctcgaaatttactccatttacttcggggagtcttatgcaagatggaattgcatttctagtggggtaacacatagcctgaagaacaggttgatttgccatttcttggattggttcaatacggattaaacgatgagaattatcccgaacccaagtttgcatacaccaaaacattttttttttggaaggaagaaaattagttttttcttttcttttaaggagagaaagaaacttagtttttttttatgagaagaaaaatcctaactaaaacaaatcaaatcaatcacttttcaatcacactctaattctagggtttagcctaactcaactagaccagctcctaaccaaaaactcctacagtgaaaagattaaagttttacccaggtagttagccaggtaaggatagtactagaggttgatcagagatcaattaagtacctcattccttgcggagcgctttacgaaacccctaaaccttgccttagacaccaactaatctgagaaaacttaaactggttcacttaaggatttcttgttccttattgagctcgaatccttaggggccaacgtctaatgagttttagaaggcttgggttatgaagtgaggaattagtgatttgtgggctaaggaaagggtgatgaaatcccttaccttatcttgattggggttttgcccttaagaatgttttaagtgtgtgccaaatcaagtgctacaatcactttggtgaattcctatactatatgaaatgcaaccctagaaattaaaagcgactaaaaatgatgataaaaagaaaatctttttttttaattatggtcaacaacaatcaaatatgagaagaggtctcttgtttgaatttattatcttgttagttaatgtccaagtgaaaggtgggttttattatggtcaacaaaaataaaatctttttgttttttttttaaatcctaagtgtctctaattgtgaagctaactaaaaagggtagaattgaaaactaaaaagaggacttacccgaaagcaattctctaaattcttgatcttcaatccaagactttcaagctccaagcggttccttcacaagaaaacacacaagttaaagaaccaaaataataaaatcctatttaagcaccgtccccggcaacggcgccaaaaacttgatacggcataattatgtaccaaaattgcaagtgcacaattgatcaagttatagtataaaaagttatcgatcccacgaggaaggtgattttaagagattattagaattggttcttctgttttgtgtntttctatttttatcataattcaacttagatttattaagcatagactatcaaaccatttaagaaaagtataacctatcaaattatcatctaagtcaaaattactattcatgataagaacaataataagataataatcctagaattcataagcataacctatcaaaccatttaagataagtatagattatcaaattctttttctaccgattagttctctagttgattatcctaaacatgaacattttaagtgaaagagaataattcatacaatataaaggaaattagactagttttatgtaattctaagattcctacaagaattaatttcacatcttaagaaataaaaaaaacaagaaaaaagaactaattacaaaaataaaaagaaaagaaaaatctaaactatgaacaagaaataaatctaactgcaaagaataaaaatctaaactacaaaataaattgtagaaattaaatgcaagaaaataaatctactctacaaaataaagtacaaaaagaaataaaaagacaagaaaataaatctacactacaagcataaatgtaaatctaactaataagcaataataaagaaatcactaaaaagaaataaaaaaagaaaaataaaagaaatacaaaccttcaaatttctcttcatctccatcctcatcattcaacaaagaggagaaaagaaaatttaaagaggagaaaaattattattattaattacaataaaagttacaatttttggaaggccttctcaattaagagtagccctcctctccaaatagagttacaaaatttttcacacccttaacccctcactctctatccctatttatagtaaacatcactgaatgagagctattggattgaaatcttatccaaaaataacaaatttcagccttagatctataacaaactgtacgatggcatcgatgcaggcatcgatacaggcatcgatgctggcatcgatataggcatcgatgcccccatcgatgcaggcatcgatgcctaccttcttctggttgctgtcctcagaactcttgtatttggcttttgggcttgtatcttgggctttggcttggacttttgggcttggcattttctcttgattttccattgggctttgaattatttcttcattaaatatttgaaagaattcctttggcttcatgggcttcatttctttattaaatcgagggctttttattgagagatgagagtttgggctcttattcttcattaacctgcaattaaagataaaagcaattattagtggtatatttattcatataaaatcgataatgagggtataaaattgtaataaaatgtgattatcaggtggcgaaaggatgcttcccctgatgcttgagtcaagcttgcctcctgttgacgatcagaccaagatcgcaagagcttctgacgtaggttaaccaactggaatcgaggttcgaactccggattgacatgtagaaactttaaactctgatgcatctctaagtccaag

SEQ ID NO: 138 - DNA, 351847 bp, Asparagus officinalis
  misc_feature (732)..(1218): n is a, c, g, or t
  misc_feature (15000)..(15033): n is a, c, g, or t
  misc_feature (20465)..(20474): n is a, c, g, or t
  misc_feature (21389)..(21398): n is a, c, g, or t
  misc_feature (21854)..(21863): n is a, c, g, or t
  misc_feature (39191)..(39200): n is a, c, g, or t
  misc_feature (51836)..(51916): n is a, c, g, or t
  misc_feature (54189)..(54473): n is a, c, g, or t
  misc_feature (71731)..(71899): n is a, c, g, or t
  misc_feature (83436)..(83445): n is a, c, g, or t
  misc_feature (108841)..(109185): n is a, c, g, or t
  misc_feature (110630)..(110837): n is a, c, g, or t
  misc_feature (114968)..(115537): n is a, c, g, or t
  misc_feature (128685)..(128897): n is a, c, g, or t
  misc_feature (129549)..(129558): n is a, c, g, or t
  misc_feature (153755)..(153830): n is a, c, g, or t
  misc_feature (161556)..(161577): n is a, c, g, or t
  misc_feature (161907)..(162206): n is a, c, g, or t
  misc_feature (171220)..(171444): n is a, c, g, or t
  misc_feature (173060)..(173154): n is a, c, g, or t
  misc_feature (185538)..(186776): n is a, c, g, or t
  misc_feature (221137)..(222115): n is a, c, g, or t
  misc_feature (275540)..(275549): n is a, c, g, or t
  misc_feature (311470)..(312960): n is a, c, g, or t
  misc_feature (319133)..(319204): n is a, c, g, or t
  misc_feature (320613)..(322500): n is a, c, g, or t
  misc_feature (323501)..(323623): n is a, c, g, or t
  misc_feature (323840)..(323919): n is a, c, g, or t
  misc_feature (326240)..(326501): n is a, c, g, or t
aaccgataaactgttaacaaagtaatcaatggaatcaataaagaaagcaacggtttttcccgcgaacacctaccagtcaatcactcgagaaaaaaggaaggaaaaaaagtctcgaaagtagttttaaacacttctttatggcttcattagcaaacaaattaaagttatgcccttttttttacttggcaaaaggttgtaaccaaaagcatccttgaataattcgtgacctttctttgtcaaaatcaagtaggtaacctaatttcttccacaaagttgttaagttggttttttttattacacattacgcacgtattttttggtgaatttcacaaatatttacaaaactaaaggatacaacttaattaaacactttgaatacctaagcaaccaaaaactacactcttaatcatcaaaatcttacaatattttttttgccatgccattgatggtgagtacgtaagaatcaaacatttcacatcttttatatatatgagaaaaatgggtatgcttggtagtgaggtggcatattctccttcactcattgaaattggggtccacattcacgtaggttggggagcgattgagaattggaatgagtggatgagaattggacacctcactacaaaacatactcatctctctctctctctctctctctctctctctctctctctctcactatatatatatatatatacacacacacacacacacacacacacacacacacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattttacaggtttcgagtcttagccatttacctacggacgatccgagataagaagttatacacatgaatttcacaaagtcaagagatttgtcttaaaaagaagggggaaaaagtaaaaatatataaaaggatatagaatgtaaaggagaaagccatagagaaactccggcttcttcagtcttcaatggaaagatttatttatttatttataccataaataaatagaagaattgtacgtaattttcaaaccaactttctaataacccgtgaatgatatagagcgctccttttctacgtggtgctaatagaatccttactcaaatgtggatatatatctaatattatattaaaatccttaattaatttgtctttccatgtgaatttataaaatgttttttatcctgaaatcttcatattgtacatgtgtctagttttcacacaagggaaaagcatgcatgaacaatgtcaaacaattgatcacttaagaaatatagagttaacctacttcgttggcacgtacgtagagacaacttcccaaattctacggatgccgaactttgttattttgacagatctacatcttagttacctaaaacctagctagtttcatattgtatgacacgcacacgcacacatcaaacccctattaattataaacattatatatagagtaatgctaataaattataaattctgtcctcctcttgtgttacaaaacagatcgacgggatatacatatatacatacatatataaattctgtcctcctacatgtcttcaggtttctcttgtaactctagcgccatataaccgaaggatagatgtatttataatccaaaattttgtcctaatatattttggttcagggatcttaattaagcagtgaatataactagaagtagatattcaagtattaatgctctgagatatacaactggccagtaccgtttatagctccactactagctagatactaataaaatagaaaaaaaatgatgataaatacctatgtatgtacgtatatacataaccctagcgagtacaagctagggacaccctactaaatatatatatacacgtgtgtgtgatataagacatgcaagtaccttaacttacatatacatataacaacaacatataataaataaattaatgagacaaaacaaatggctagtgccgtattctaaaaactcaacccatgttcaggtgaccaaactgaacacagggcggctaatctcaccttctccacaagagaaaaacgcaacccagttggtcttcggcagcttttgtcctctactttcaaagtttagtcggtgagctcaccaccctcctcttatcctcacccctactcgatcttttctctctcttttttcttcaaaaagaaaagaaaccttgatcaagctagcttgctttaatttttgtgaagaggtgaaggttagggttttgatggcgggcggtcatagatcatttcatggctaccaagatcaagaaatgatctcttttggaatgatgagtcaatcctcttcttctcatcccaagcatgaaaattccatgtaacttatttgtcacttttatatgttgtatctttttgtttgaagtcagtaagagctagatatagaaaaccttatagtacatgcatgactcagtttgttattttcattttttttttaaattttatgtgtgtatatcctttagtttaaggttccacttgttaggtaggaagagttttttgattaattctgtctttttcgccaaaattaacactttgtttgaatgagttttttgattaattctgtctttttcggcaaaactaacactttgtttcattcaaacactaaaaatctacaagttgtgatcatgatatatgtccttttacacgtgatcaaagtgaaggcctggaagagcagcttgatctagttcgtaacttgattaattttacactgaggccggtattatgtttgctttgatatttaacaggccaaaggagggaggaaactatgacataggggagttggatcaatctcttttcttgtattttgatgggcatgataatccatcagttgatcaagagcataagcgtaagtatcttcgatcaattactttttatcatcttcttatatttgaatttgattttataaaaaaatttccctttttaagctaatctaattgcatcttgaatggtttatgttaatttccttcgatttagagtcatatggaagtgatagttgtacgaagtcaagtttttcataattcagagtaactttttagggttccacaagagaagtacgtagatatgtgatttagttttcttgagcgtcctaatatatatttttcttattaatttttgagtttttcctaatttgcaggaactataagttcatttccccctctctatatttaaacttgtactttgttacgtatgcaaatattaattctgaaagttgcaccttcagaaggtttaatgcttgcaggaattaattcatgtatgcagagactcttaacattttcccttctgagcccatgaatatagaaccatcaaccaaggttcgtatacacacataaatgtgaatcaaattaaactaatattattcaatctatttaattaatccttcatttatatcctaaacttagtcttttcgctaatcgttttttttcaggttgatcttggtttactcccttcaacaagcaattctaattctcagagatataatattgaacaaccaatggagcgtgataatccaagagccgtttcatctttggctggaaaagggaaagatattaaaacttcactaaaagtacagttagaacatgcactttaatttatatcatgcataaaaaaaaattcagtgacccaattaattagacatataattaattattcttcccttctgcagaatgaagaaaagaacaagagcataatagcaagttcagatcaagaagggcctaaaaccccagatgccaaagtgagtcaactaaatgatattttatgcaattaaatcaacaaattataatagcttcatgattcttcttggtacagactttgagaaggcttgctcaaaatagagaagcagcaagaaaaagcaggctaaggaagaaagtaagccaaccagatgaatgagacctctcgtctgaagtcttaacctaccatattctcctaaattttgttttttatttttctttccccaatttacattttcccctctcttctttttatttattaatttgacaggcttatattcaacaacttgaaaatagcaggatcaagctactccacctagaacaagaactccaaagtacaagaactcaggttaatttcatatatatcttcaactccatttacatatatacttctaatatatattatcttatgcaacgatatatttttcttaaactttggtttaaaccccattaattgttctggtattatatatcttaaaaatctctgatctgttacgacaaaatttcgattcatgcatgacggtcttaattttacatttctaacgtaccatatatctcttgttgccctaatatttgacctggaattaatattcgtcttatttttctttataatacttaattagtctatgctaattgatatcctaaccaccatttacttcttgtaattaattagggcatgctcatcagtggagtaaaccaaaaccttcctccaaacccaaatgggctcacctcaagtactaaccttccaaaccctaaaacttcatatattagtactgttatacatatttaatttttaactaacccttccaaaaaaaaattccctataatatataattagatgcagttgcattcaacatggagtatgagagatggaaggaggagcatcatcagatgacgtgtgagctgcaggctgcagttcaagagaacctccctgaaagtgagcttagggcttatgttgacaaatatttgggtcattatgagaagatgatgaagctcaagagcgtgattgtgaagcttgatgtgtttcatatagtttctgggatgtgggtttctcctgcggagcgctgcttcttgtggattggagggtttaggccttctcagattctcaaggttcttaattttatagaaatcttcatggaactttatttgattaaattcatttcttggtatatttatcccttataagtttgaggaatttatcatatacttcttaattaattaatgtatagggttttgagttcattaaaaagttataaaaatcgcttcatttatacaatgctttgtagaaaatcagtatcatttattaaacataataataaatttaataacaaaatatttttctacagttttgatggaattaataatagtaaaagttgctatgtgatagtcaatttcacacatttttttccaattttttcaatattatcttcacataaaatgatgggattataagaaaatatagtaaaaattgcagctgtatatatgagaaggtttctttacttgacaagtaatattggtttaaagcaagatgtagatgaagaatgtttttatttttatttttattttttactttttgtgagaaaaatatgagatgtaatcacttcacctcctagtgaagggatcaagctcgaggatttattttccacatattattgacaagtattttttttctttttctttttttgttggggggggggctatcaaattttaggtgcggaagataaggaaactacgatctaaaatggtgaaaggtctcagttaataggacagttaggtgttcttttttctgccttttttttatttttttatttttttctggattagttagaatgggattttataggtgtgaagactttggcctggttctcttgtcttaaagtactatttcttcatgttgaagctggtaaagggtagttggtgatgaaagatatatgatttaagctgggttagttaagagtactattgaatttgggaatattatttggattagttcagagtactctttggtttcaacttatggttttttttgttgtataagggaagttgttttcttaatgcaataagaaagatgatgaaagtgttaaagaggagtatgttattgaaattccttctttttaaaaaaatgtttcacatatatgtattatatttcttctttcttactttgtttacccctactagcagtagatgacttcttttgaacttcatatattttctgtaattaataaagcagattttctggaatatgagaaggagatacactagaaattgagcatccagagattcaagtaatattgatatgtgcaaatagaaagagagattacataagtatttatacttacgtttagcgttagaataaatatgttaaacaggcatatattattggataaacttgagttaaaatattacagtttaaggggggaaaacatctcacccactcatcatatatattctatctttttttttaactgaaaaacagggtgagaggtcctgatgtagacggtagggagcgaaccttgtcgtcaccatccaggctacatctgccttgtttccatccttccagggctcaggctatagaagagtgtgctgataaacttaagacaacacaaataattacaatacactatactagatacttcaaaaggatagcgagtgaatcctgcttagaagttgtccgttgctatgtttcccgccccttctttagctagctcctttagaccgagatcaatggcagccttgtgaagagaggcggcccttctactactagatgctcctgtctagaacaaggtaaaacgagcaacattagaggtatatattgtgaggtgaaatatggacatcgttgatatgaggttgtttctactattctaaatccaccaccagcagcaagggaggagaaccctccagagggctctaagcttcaaattagccaagaggttgggcttggcagagataagatggtccacttcttgaggccagttcccaatctgctcgtatgggatgaggactacccaaacatttctagtgaaagagcagttattaaagagatggttatgagattcagttttagtgctgcacagagagcatatggggtctcctgtccattctttcttagataggttatccttagtattaagtttatgatgactcaaaatccaaaaaacccttaactttgagagggacaggagatttccagataaaatttgaaagatggtaggtggtacctctaaagttgagaatattgtagaaggacttgactgagaactcgtctgatgagagatgaggccatgttataccatcttggactaatacatctggtggcttggttgactcaaggagaaggtagagcttggtgatatcagatctctcctctgctgtgaatcctcttctgagaattgggtgccatttccaggtgttatggatgaataaaccttgagaatatgtagaagtgttgtgggagaatgctaatttgaacactctagggaagagactggagagtgttgtcccccaaccatttgtcctgccaaaatctgcaggtgtaaccagctccgagagtccagcggacctggaaagggtcttgaattaagtataagtctttaatcagattagatgttgaaacttttaggggattagatacagggttggagtcgtttacagagtaaatggagaagatgactttgctgatataagacttattgtcaaggattttccaaatccatttagaaagcagagcaaggttgaatggttgcaagttaatgacacctaaacctccttcactcttagctttacaaactctaccccagttgaccagacatttaggtttagaggactgcttgtagtcaccccaaaggaaatttcttctgattttatcaatagctttgatgagcaaacttggaagtttaaaaaatgacatgtaatataaagggagagaggatataacaaagtttatgagagtaagtcctccaccaatagacagagacttgtttttccacaaagctaacttcttagagaaggaatctagaaggggttgccactcccgtctagtgagggtaccttttttgagaggaagaccaaggtatgagaagggagggagccaataaaacagttaagcttgtttgccagatgaattcccctactagggactatgcccaggtagtatagacatgacttgtagtgattaacattgagacctgagatgttgccaaaaatgaacaagatagttttaagggtaatgatgtcattatgatatgctttacaaaaaatgagagtgtcgtctacaaattgaagggttcttatagaatttagctctcttttaaggttaagatcaaaaaggtctcctgcctgaatactagtagatatcatcttgtttaggacatccacaatcaacaggaagagcaaaggagagagggggtcaccctgttttagacctcgatggcatttgaaatgggtggttggagaaccatttacaaggactacagatttagctgaagagaggatgtgggatatccagaggcaccacctgggattaaaacctctggctttaagaagggagagaaggaagtcctaatgaacacagtcaaaagctctgaaaaaatccacttttatcgtacacagttcttttttgccagaagagcgacagttgatcatctcatgagccagaaggattaagtcaagagaagatttgcactttgaaaagcagactgagatttgtctaccaaagatggaatgagaggcttgagctggttggctaagcttttggtgaagatcttgactgaactattgataaggctcatgggtctgaattcagctggagagctggccccttccttcttaggaatgagacagataaaaaagtagttgatgttatgaagaggttttgtatcaagagtgtaatgactggataaaggatataccatcttgataaatgacatgccatttttctgaaaaaatgaatagggagaccatcaggccctggggatttgtctgggtgtaggtcaaaaactgcatgcttgattttgtctactgaggaggatgagtccaaggtagaaaggtctacaggagagggaggataaagatgattccaattgatactgaatctggaggctggttgagcttggaaaagattagagaaatagtcatagaatgcctgtgttattgacatctgactcagaggagagaatagtgttattgatggaaaggtagggaatgaagttgatcctcctatggtgagaagcaattctgtggaaaaaagttgtattgttatctccttctttaagccattggatcctagttctctatttccatttaatctcttcagctttggccagagaaaaatggagctctctaaggttaactctgtattggagttcataatcagaaaggggtctagattcttctaaacagttgagatgatcaagatcatttagggccttggatgcaagctgagagttggattgaagaacgtgtctttttcaccatttgatcctcctcctgatgagtttgattttaagagggagggaggctgaatggtcattgtgggatgagaaggagatccaacacgactgaataaaaggaaagaaagagggaatggtaaaccatgatttttccaatctgaacactggcgaaggactgagaccaccagaatatagaataataggaaagtgatccgagcagggagattaataagcaaactaaaccagaaatgggaaatgggactcaaaatcatgggatatgagaaatctgtcaagcctagctagaactggattggctctttggttagaccaagtgaactttctaccactgagaggaagatcatggagttggaaggagtcaatgagataattgaaggagttgatatctctaatggagccagtctaccacttctctcatctaaacttaaagtcaaattaaaatctccaaaaactacctaagccaatgacgtggattgcttaatcctggataattcccaccagtagacctctctatcgtctttatcgtgaggagcataaacaatagtggcagcaaatttccaatttgaaggtttgtggatcaggaagacagtaactgagaatataccaatagacgatgatgtacaggaaaataatgactctttccaacccatcagaataccccctagattccgtggcatctaaaaccgaccaagagaatatactgctactccccaaactattgagggttctgggagagatggaagaaagttgtgtttcttgaagactcactaggtttatatttgctgactgaatacagactttcactaatctacatttagtaggattatttaaccctctcacattccatgaaccaagcttcattacttgatatggaagacaacttaatgctagaaaccatcacaattaggtggggttggtcccgactttttccatagcttgaagatctgaaagtcctaggggatcaactggctcttggatgccgcaattaatagcaatgtcacggagtttgtctatgcagattgaagaaataggcatagatggggttagagatttacctttatttccacctgggggggactccttttcatgaacgctatgtgctttctgtgaggcaggtgagcgagcatcctttttgaggacttccttttggacagtttcttaacatgctcgaagcctgaaggagggtctgatgatgagacgacatccatggattctgatgagttgttgatgttaacgggagggatttggttgttggagagcagaggaactgttgaagctgcgggctgatgaggaaaggctaaagagagcagttcccaggagtcttttgcaatcttgatagggacccccttgaagacgacctcaatgaacttagctggggctacttcacctagagaggtcccctcccccccgacatccatgacatttttccctttgtggtcaatatggatggggactgattctatattctagttggtggttgctgctgctgcttggtttgcttttgtcgatgatgggttgagggagggaggaacttttgatgaggatgatggttctccttctttcctaataaaatgctcaaaatactcaagacattacctttcttttccggcagtggttttcccactccctaagctgaacagatcactccatagtgtgactatcatctagggaagaatatcgaaagataacagatcttgggatctcagcagtgtcccgaacactaagcatagctttacgctctctggtattagatttgatcatgacatcgtctgagacagtgataacgtctccaatatcccctaacaactgcatgttaaaatctgaatcccataagtgaagagggagacctagagtctcaacccagacatacataaattttggaagaacttttaaggcccctttgctcagcccacggggtaaagactcctccaaaagtacccatatcgaagaactccttggagcaggcgatggctagggtttcgtcgttgggaaactgaatgaagaaagccgagggggaggaacacttgatcttgtatgtccatctatccactttgaggtggtactccagattctcattgagttccgaaagaagaagggttgcccacttggagttcaaaaaaaccataactagaatactccttcatgttgttgatgactgagggtggcagctcgatgtttgggatgaacagaggaaggggagaaggagcggaggggatgatgttatagagaggagggttgttcttgctaggacaatagatcgaagtgtgcacaactctattgccagcaaagcatttgaaatctcccaaggtgcagttcctagctatatggaatttgtcaccacagaaaaaacacctagaaggtttaggcttagggggagcagagaggggggttgggatgcttgggtctctttttgttggacactgtcttccagcctccttcatggaggggggggatacccttttgggaggagggaggggtggacagagagaggaggatgagttaatacccttaaagaggtctgtgaaagaggagtaaagtggcggagaagagggaagttgctaaggtttgggagtgatggaaggaggaggaggagggaaggagaaaactgtgggtggttgggaaggcggagggcctgttttgggtggcactgtgggtggattgatggaaagcaaaggagtaattgtgatgttactattgttgatagagactaatcgccgcctggatgaacgtgctgccatgcaccttttcgcctcttcgatcgccttttcgcttccatctcgcgaaaaaggttttcttgatctggtgaactttatactttgaatttggaatttcagtaattgaatccaattctatcatacgagcatctacctgggatttgaaaaattcattatcataaaaattgagaatcataaatttcataaaacatgagaatcattaatttcatccaaaagatggtatttatcataaaattcatggtagtatgaaataaaagtagttaattttattttagttgattctcatgaacgatattctgaagtcatgtatcactttggtgaagattaaacttttatgacttttttttctctattacaaatgttagttcatttttttctgcaaagcccccaacagttcatgatatagttttgttatcattacactggatattatctctgattttacaaatctgtggttgtgtttgcttaattaattagattgtatcaagacacattgagctattatcagagcagcaactcttgggaatctgcagtctgcagcagtcagcacaggagacagaagaagcactgagccaagggcttgcaacccttaaccggtcattgacggagactgtcgtctccgatgctctgagcttctcctccgacattgccggctacatgggtcagatgtactcggttgccatcaacaagctcaacaaccttgaagcttttgttatacaagtaagaattactatatatccaatactacacacaattaatacataaactgtaagtttcataggcagtaactatgtatcatgtactattcagggttctgcgtaaaatatcataaactattttgttgcaaacataccaaaagtttctacattagcataaaatgtcactaaggatggttttatgatagtacctgagatctagtccttgataattatataacagtagtgtaaagtccctgatatatagttaacaactttatccaaaagttattgacgtggctttataaaatataaataaaaattcatgatatttagttcatgaataatttttttttacagtataatacgccagtcaagcgtcgtatcgacacacaagcctgtgattactcgttttaattataatcctgtacttttctttctcccctgctgagcgtttacgtgccaaaaaaggggaaaaaattaagaaatttcaattgcaaatttgcaggcagacaacctgaggcagcacacaatccacaggcttcaccagatactaagtggtagacaagctgcgttgtgcttcttggcgatggaagactactttcatcgtcttcgagccctcagctcactgtggatggctcgtccaagaaacttttagacgtcgaaaagatttgtagagagatgtacagatgctgtcagttctttcttgaggaaattttgtagattagaaaccaatgacagttacagaagaaaatactgaatacatttttgctgattgcatgttactttaaagggaattaaggtcatagaggatcccttgaagaaaatcatataagaggaaggataaataacgtgtagactttaaaatcgatgattatcgcatcgatacgattgtctgttttattgattcgtagggaacttatttcgatcttacttcttacatcatttgttgcatcaaacacaataagggaaagaagaaaaaaagaagaaaaaagacatttcatcagaaggacaactgtcttcacttgaatacagtggttggcagcgataatcgtttaactgcagttcaattagtacagccaataatgtgctgatttagtaattataatatatgggttaaacttcatggaatgtcatgtatcattctctcttttcttcccatacagtattttcctttattgcctaatcaaagaaagagcaacccaccgcaaaaatcacaatacaaagacaaatcttccatttttgtcagcaccaaagtgaatgaagagaagaaaaaaaattttgtaacttcaacaattttcagctacatttctggattctccaacagaaaaagtgctgagatgaactctacccatctattacatgctgaacaccctccctgccatgcttttaaattcggtatacagagtaaaacaggcacaaaacaactgtggcctgcaaagagaaaatgtaacaaaattaaatcaaaaaaaagttgtcaagcggccacttattaattataccatctgggatctgaggtccccagcaacagaactcccagctgtgaatcgtaacatattaagcactttcaaaatgtggcgtgtgatcatgttttctaaaatgcttctgattgttcatgctgcattcttcgccttttgtttctgcttcttggaatcaagagaagccaacccaccgcccaagcctgcaggagtttggctgtcagccgatctatttgtgtccttgtcaccaataacagcaccatttggcgtggggttgtcactaggatccttcgtttcagatgagtgggcagtttctgtagctgttgaagtattgttgatgatgttgaggagttgagcgagtggtagaggttggacgggagcaatattctggctaacaaggagacctctcgctgctgctttctttcgagcttcagcagcagccctagcggnnnnnnnnnnnnnnnnnnnnnnnnnnnnnnnnnngcttgtaatgcttgtattagattgggatgagcctgttaaaagaatggaaagggaaaaaaaaagttaagagcataggacctcttatacacccaagtacacaaacagggtatggagggccaatgaacaaaggacagaacttcctcacatggcacactaaaactcaaatatctgcatgtaattgtttcatgatctaaccaataactataaagttacaaaatctaattataattttcccatcagtttctcagtccacaaaattattggctctacatgatttagcaactctccaacccatggcagcatcatccatattaatctcaatgtagtaacatcacataacctagaccagccttgtcactcacgatttaaatctaaatcaaaatcccaataactagattattcttctaactttttgttgcctcacaccactggtcttcacctctctggccaggctaatagtattccttatttatatgctatatctttacaaagttttgtgtgtgcacatgcgtgtttgttatatacaagcatccagctctctttctgtacttgcggtgagttacggtgagttctcaaaattagttttttgattaattaagaatgtacaaatttagttgacatcatgagttacagtaagctctctgctacacccttttttcctcacatacgttgttaaaaaaaatttcttcgtacttcaagcatgtattgtatcatgcacatatcatgtgcaccagaagactagtatatcatgaaaaaacagaacataaaagaatgtaccttcagaatatcaatagccttttgggcagaagccgaatccaactcctgacctttctgtttctgtgctttaacctgccatggaaataacacattgaatcataaaaagagtaaggtaaaaaaaaacaatttgaatgctgcaggtaatcctgagcatttgaagctttgaacattaactttcatttctattgaagtggctgatatatgcatttagtcagatcatcagatacagaattcctaggaccaactaaaatctcaggaaatagagcatttacatagaaatgtagtattattttagaaagtaaaattgcaattactgattagtactgtaccaaattcatacaatatacacaaaaatcagtttcatggcaggttttggaagataacgtgtaaaatttgtggaaactgctgtttcagtttaacaataactgaaacttcatttaaaccctgttccgtgagtacaggttaaacctggcaataattatgtaaaaatatcattaaaacattctccagtaatttagctatcttagatcaaattctcaacattctcataatattaagcatgtttccagcatactcattaattttccagtgattcattctccttagtcaccttccaacaaaatacattttctcataagttgtatagattcccaacaaacttttctctagaattccaattgataaaacatattttcatttccattcacacttttcaaaattatgtttcttccacaagtaaaccacattatatttgcatggttccttacgaaagaagcaaaacactataagttagagacttcaacatgctgacaatataagaaatgctagttacctgcagttcacgcatcttaaatgtcttcatccaattctctgactctcgcgtccgtgaatcctcctccccgagttgtttagaaagtatatcatagttttttttctcatgctgtaataagaaacaagaaattcttacaacataatacaaccaacaacaaaggccaatagccgtgtacttggagtgacatgcctgaagagagagcttgtaggctcccatacagttgaatgcaattgcaagagcatggtaacaaactgcggtttgaatatgttctggaccaagaagcctctcgttcttctttaaggcttcctgcaagtacctcagtgcagcatccattttcccaagatcctgatacataattgcaatgtttatataagttgctgcaacatcaggatggtcagggcctgttgataggctcaacaacaacagtgttctggacatgtgacgtaaagccagctctgtttgagtgaggccgtgatagaagagagccatgtttccataactgaaagcaacataacaatggagcaacttggtaaaagataaagagattcaaacaatagaaccaccaaaaacaccaaggataagacaaaacctgtgggctgtatcagggtgatcaaggccaaggcaatgctcattgatgattagctctttatgctgctgcataatggctccagccaggtcgcctgcatgatataaaaccatggcaagatacctgaaatttcagatgtgtacaccgtcaatgaaagtgtgaacctttgtcatagacaagtaaatctttatcttctgcacacaactgagaggagggaaaatctgacagtatcagttttctaacagatgaccacatgcagattagaaatagagaatagatcaagtgctgaaaacacatagcatacttcctaaggcgaaaagttggcgacattctggattaatgcagatcaaaattttggatattcctccagaactttatgtatgccttgcaatcatcaagataaagaaatataacaggccaaagcagactaaagagcagaaattctaaaaaaaatcttggccacaatgtcagatggccagcctaagtagtagcatatagggccttatagaacataaccctcaataccaagtttctccctaatcatagccagctctagcaaaaacaatattaaacgcccaatttcactatttcagcagttcatttagaactgcctctatatatgatattagtagcaataatttcaaataatagagtaagctaaaagtaaaaataggaaagacgtggaataggctgtttttccttttcttaagtactttatgttcaatcactaaaactctaatattacatggagttatataccaaacattgtaaacatatataaaatatcacacaagtaattaccggcaacaattagcaacctctctgtgcatcggacctgtgacctgtatcaattggcttccaacttttagaaacatcaatgctgaaatgctgaggtactacagaatgtagacaggaacagacaaaaaatagcttacttgttgaagtatggaaaatgcttcagaaaaaagagtgtaggcttcatttaataatccctataaaacaggaaacattttaaaccataacattcataactggatatggagcacagtgcaaaatgaacataaatgaacactttcagaagactgattagttccaaaattttatatgacgcataatttgcaatggaaatggtatgctaactgctaagatacctcagcaagccgatttttccctgctgccattatatcccttgcttctgaacaaaacggaactgaatgtttaacaactggcatgaggtctagaacatctgaactttgaaagggtgatgcagaaccaagatcatatttccgtgatgcaatttttatgcctacctgttagaattcacgaaaattgagaatagataatatttaaaatgtcaatctgaactaatcaaacatgattatactcatcagatatagcaaaaaaagcaattacatttaagaccaataatgatcctaaaccagctcaaagaatcaagcacggagtaggtgagccaaaaaaagatgatttactgtgtgaaactaaacttggataagatcatatttgatatcttcggcattgtgcactaggacagtaagattctatttgatatcttcagcaccatgcactaggaaaaaggtgtaccttttggcaaagatttcggataactgaaaccttctttactcttgactttgcatcctctggtaattcaaactacatttgataagaagaaatttagacaattttatatatggaagtatattaatagaggatgcccaggggctcaatcctggttcacactacctgatacttagattttgcaaattcctgaatgcatgaccagagtccttcagaagtcaaagacatgtatgcggattgacttgtcctagaaactgtcccataactccactttgtttgccttttacctgatttgcgtgcagactggacatctgagtggtcctggaaatcaaaatcaagtatcaagtgatctgcaggttaaactttagaagagagaatcagggaggcagcaaatgagaggaaggatacacatgttccatgcagagtgtttaacagacaagtaataatcatcaaagtagaaatggtggtatgatcatgccatagattattaaccatttgttatgtggcaactacccatcccccaggcaagggcaatgccattcagttttaaacttatgaaagtgggagccagcctccaagaaccttgatactagtaataaaaaatggcatgttatacgtagtgtggagggatagaggaagggacagaggggcagagagatgcaaggcggttaaaatatttaacaaagatttcacagtttatgttagcataataatgaacctctactgtagttggcattcaagtactggaaatcaagtgtacacctatgggttatgtcactcttacttgaggtacttatgctatcagattgaagtatcaataagcatgcatatgatggaagaacaagtatcccaaactatgaaaagtttcactagcatgcacggatacaagaaaacatatagagatgcattgacatgaagacctagaagctgaatgttgaaagatgcaggttttgcaaatttcaagtaccttttgaggctttgtttgcatacagtcagtagcacctttctcagaaggagtcaatataagtccaaaaaaacaattgaagaaatgtgagatagctggtgcaagatcatggtcctggcagtccctaagagtatcctggccaaaaatgaaagaatttcatattaagatgataactccatgagtttattataatggtatatcatagttataactgtcttacaagaaatactcgttaaggctattacatctcaatatatcaagttcatccactagggattaaattcttgaaacagaatttccacagaagataacgaacatataaaggcggatctagattttaaccaaggtagggcacgtgccccctttcatagttgtcaattatacattatatctaataaaagagcatattctcaatctaaaaagtaaatcctagttatcttccagttcacatgttttcaatcttgccctttctttttctggtaatcttgcatcttcctttaatattacccactaaatatgttatcaggttaagaagcaatattagttttgaacttctatcaagtaataaacttaaaaatcaatactttgttgtctagacatttcaaatggttcagaccatcttataatttttttttttgtttcttttgtttctttttttttttttttttttttttttnnnnnnnnnngattgataccaagctaatatcctcaagaaatcaaccttcagtctaattagaagcagaattaccgaaacgaagagaaattcatactaaatgatatttggaaaaacgtgctcaccttaagtatatgttttgttgacctaacgatgacctcagtagtacataaatcccataaatgtggcagatgtttggtcatattagctacctgaggaacaaaaaataatgcaagctatcagcaaaaatagaagaatttaggggaaactcaagacaaacaagagcttgtaacctttccgaggtagcgaacatttatcccctgggcatggagcgtatcagtcaatgtttggccatccatcggtgaaacctcaagggcacaaagatcttggacaaattttggaagaacaacatccagaaggtatgaactggcttttctcacatttgcttcatctgctgaattttcctgtaagagaagaggaaattttgaggattataaaaagtggagatcatgaagtggagattatgaaaacagagaaagaaaaggcaaaatgaaaaaccaacaattagggattttacctcttcgcttcctcctagtttaaagtctgtaaatacattgggattcaaaagtatttctgcacaggatttgcaactgctatctgcagcagatgtgcatccttcactactctctttatgcacatctgttggtgtttcctacagaaagaaaataagcttatttgacacaatctctgtcacaataatctaaagtgttttaccatcagaatggagttggctcaggagcacagggcaccatgagacttgtgacaatattttatgtccacgtgacatcaatatttagtttgatgccagagtcattgtcaaggaaattatgcaggttcaacctcacacaaaaagaggaagaggggtggnnnnnnnnnncaaatttcatgtacactaagaaagatctagaagaaaaggaatgataatacatttgcttatgcttaacttcgagttgctcgtgaactcaaagaaacaaataaaacacactctcagtggagaactcaaaccaaatatctcaaaactgaattatttcaaaatttcagaactcaccgttgcatcagctacactatttttagaatccgatgctattggaactacttcggttttagcttgtgaccgtgacacctctgtagcttcatccttgctcacattaagatagaggataatcaggaagagaaacaagaattatcattaaaatactctagatgaggggggaaatataggaatacctggcaaaacatagtgacaagctcaggcctcaaaacacaaaatcgagagctgggaccagtgtaatttgaatcgcgaggggttaccctcattaaatccaaaagatannnnnnnnnnaggaattataaaaggaattaagaataagaatcttttaaataagctgataacacagttgctgtaaggacatgcatataagctgcataaaatgtaatgaaatattggagaagcaagtctgaagagcacctaactttccccctgtattctaaagagcccctaagttttctttttcacaaagcagtcctctactttcaattccagtttctcattaccgcatggacatctttagacgtttaaaacatgggtattttggtctttattttaattttttagcattgagcttcaattccagcataagctttgatcagttacttggtttacttgacactgttgttggggataaatgttccctgtaactatcccaccttacaagacagagaacaatcagaaaaagactaaaattgaagtattggtaaatatagtcgtatagaggttaggagagaattgttcatacaaaaacgcaatgcgcacatgacgctcaactcccatttcccacaaccataacaaaattataagatccatgtttctctgtgtgagaacttaaacacatttcaatatacaagatcaaagtttgccaagaagcacgagaactcaattaaccaagaagcaaaaaccctaatttggagggggaaaagccttaaatttcaaattgagcttctttgagacatttacccttgactgtgttaaagaaaacagcttacttttaactaaggcactaatgaaaaaacggaattgaaagttgagggcagcttgtagaaaataaaaacttaaggccttcttagaacagatgagaaaatgttaggggctctatagacttacctctctgaaatattgcacacactaggaaccatgacgagcataatttaactccttcactctccaatacacacaacaacaagcacacacaggcacttgctcatataaatctttggaagagaagcaaacaactgttacatatcacatctgcatatgggaaagaagttgatgtcccaagaagttgtgatatgctgctaacttcgctaaacgaaaagatggaatccaatgctcctgaacatgattctgaatgtacaaacaattattaacctttaaaaatgtaaagagggcgtgttatgtcctcttttcttatacaagctaatcattttataaatcattgtgctaaaactaggttcttttgaataaataaaaaacaagtgaccaaccaatgtttacacttatatgcaggggtggacctacatacggtccaagaaggccttggcccgcccttgaagattgaaaaaaaaatcagctgcataggtgggttttgggtttagaagctgaaggctgaggaagaactttaacaattcatattagtccctcaaatcactgaaattgtttattaggccctcaaatgcatattaggtcttacaaattggtccctctagttatctcacattagatctgaggggcatattctctcaaatctaatgtcttgaggagatgttccaattttacctcttgttaaggttttcaactcatttcttaactgctataaacctttaaaataaaatttatgaccattaaacttatattctccaacaattagaaaatgattccaaccaatttgtgagtttcccaaagattgtattcccccaaaatctatataatcttaaaaaattaagggactaatatggaattaccgaagagggaccagtactaaaaaatctagaaacaagaatttaagcaagatagcaattctcttgctaattttttctcaatagtttcataaactgtgttcatgcctgaacctatgaaagtcacatctccttatattgtgttgtaaacctatctctaatacaactcataatttaaaactagaatttaaaattcaaatcatgatctaaacctactacaattgaaaatccaaaataactctatcctaaagaatgtggataactcaatctaatgaaatatcatatctaaatcctaaaagataaagtcgactaacgttccctctctcctgccctgctttaatatgttgtacttatttactttttgcgcctccctccccctcttcaatatttcatggctccgccattgcttacatgggtcctatatgcttaaactaagaagaaatatacataaatagttgtctcctcgtatctggatttggaccattgcgatgtctgcagatcatatctaagaagcaagcaactttgtaatgttcattaaatgcatagtgttccattgagatgaataatcctatatgtgcatttgataggaatatggtaaaatatctatgatatataaattataaagatgattttgccaatcattttaagggcattttatgcatgttacaatggtacataaaacacattataccaaaattataggtctgtcttatactgtcgtgtgatcgctagaactcctaatacctgagctttaaaccctcaaaatgcttctagatgtctctaaggcagtgtttagcaacacctccactaaccacgtaagtggagctaacctggataaggctttgttttttgtttggctaaaatagggccaaccctagaccaagtattgttcagtgttgccaatgcgcgacgcgcgaggcgcaatgcggggcgcaaagtatctttatgcgcacatgcgcaaggcgcaacgtaatgcaggcggcctagtaatgcgaggcgcacatagaacacataatttttcaagatagataatcaaacaagaaagaacatgtttaggaattcacataaaaaatatgtcgggataaacaatatcttactacaaaatcataatataaagtcttaatttctaatgctaacacccaacatagtagcaaagttcttaatttttcaaaggattagttatggtccttaattgaaggctactaaaaaggcctaatggatttattttactttttgggatatggattatcaagtataaagactcgattgaaatgttaacaaacaaaaatatatgaggatatgtactacatgcaccctgcgcaaagttaggatgtgcgcaaggcgcaaaaggcgctactgcatcatatgtggggcgctttgccacagccccacatcgcaaggtgcatgaggcacagtgcggggcgcaccttttaaaacattgggttttttagttcattgtttggcatttattcaagttaaagttaattcaccacctgtctggctcaaaactatcatggttaaggctttatcaggttagtgaacagttgtcaaacacagcctaaggtatgcaaatcatgtgatacaaagcaaacctaaattggtcctttcttctacttacctttttctcaagttgttaaaagtgaccccgaacattaacacaaagctgcctgtgaagaaatctatcaatgttctagagggagctgaaatacttcgatggagccatcaaggatctagtaatatcctttatgatgcttttgaacacttgatacacaaccagaaggtatccagacagcatgttttttcatccattacgttctacttttactataaagatcatgaagcaacgaaaatgaaagctggacagcttggacatgggaattatattcacccaaagaaagaattgcctcttctttcccttgtacgtgtgtttccaagagtgaaaacacttaggccatgaatatcatgatgaacaatatagatcattcatgatagaaaaacatgtacaattttggcagctaccttgtgcagaattgcaggccaattactataaacttatatggcaaaacttaatagagcagaaaacttccaatcaatagcatcctaacaccactgtgctcaatgaaacaaagtgtacaaagtgacatgcaaagagcatgcaccacacttgtctctcatcacctagcagagataaccacactccacacaccctacgaaacacccacccacgtgtgctctctttcgcgcatggactttaattatacaaggcacataacagagctttgagaagaatgaaaaatcactcctaacaaagactaatgaagtcagtgtcacctgtcatcgctgccaactatacccttgcattcaactggagcagctagtttgacaacattgcccgaaccatctaaaacagtgtgttccttcaaatggagacgtttagcagcctctaatacctataacatgaaaaacaaaataagaattgctgtgtgcaaagaaaacatgaaatatagtatctacattctataaacaataatgattgcaggaaaattatgcaccaaaaaacatccgattatggatgccataatgaaatatagcatggaattactagaaaaagtaacaatgcattgactaagcagggaagaccgacaatgctgattttgcccaaaacctcaatggtttaactaccatctctcaatttcaatagatctttctccttaattgtaattatttcttccaccgcatgttattacccataaaaaatggcaggcaactaacaacatttctgaatagaaactgaacattgacagtgggcaactcataatagcagacattaaacaagcatcacaccttagaatggaaggattcgctccaacaaattttctttccattgtcaacagaaccatatagaagggagtctgatttatcaccttgaaggatgccaggtataatgctctgcaggggaaaaaaatgaagtagaagtagaataaaaaaagcaaacaaaattagaattggttgggaccagagaatcgacccactgctagagataacattagaacactcagccctaatttaaagaattgaataacattagaagatagttttaatgtcaaacctgtgctactactctatgacctcggtaatccacaattgccatggcaagattgtaaagtccaggaacatcggcttcttggtaagctcttgttccttttaaatcattattagcagaagcatatgtagcctgctcgctgtctgcaagttgtgcttcagtagcagcagaatcatcagcagcacaactctcaacttctgcttttgagctgtcgtaagtacaagcattagtttcaccattggtttcacatccggacccatgatctgaattactagaggccttcgcagctgaattaggcaaaggtgttgtacttccttgcagaactgtgactttcaaatcagtgctcgtttgtcctttagatatcaggccaaggtcggcatccacagcaaagctgaagaatatgttgttgtgaacatacctgatgcagaacaagtaaattagaaaagcataacattttccaatttcaacttgataattgtaaacggcaatgcacatgcccatatattactgtatgctagaaaaggaagaactagaacatggtagagtatattattagcaaaggacaaacatgttcactgggcagaaaatgctcgacaaatacaataagggaagctgatatagctcagtgatgaaaccttagtatctactcaagaacgggccacactgtcatccagctgcattcaaatgaaaggctaaagaagtactaaaggaagacagaaatattaaaactattggtaacgttaatgttcaaaattgcaaatactaactggacaaaggtcaaaaattctaattgtgataggtacaagaaatgatgcaattaatgtattctctaatgaactgctctaaaagaaagaaacctctacattccagttgcaaagaaaactagagcatataaagacaaattatgtagattttctaacgtatgaaactccataaaaagtgactgctaggcatactcacatatggaaacactctggatctgttggattaattggaggaatgcatctgtttataaccccaatggcacccttagatgccgcatcaacaaaatcacaactcaccttataaagagcacgatcacgcaagatcctgaaagatgaaaacaaattaatggacaataattgccgattagctgtgcacacacttctaaatgaaattaattaactgccaaaaaaatagaccctaaacacaatcaacaagcataaaacatgagtaaaagaaatgacatgtcatataatacacctttcctgaagagttgtatgaggaaactctcgacaagactgtaattcctcgttccagtctctctgcatgccaatgagttcatttccataagaaagagcaagtgcatcctctgctctggctgcgtctcgcttatgatctgcagatgatcgtaataatgcagtttacacaaggatgtatagggaaatatttaaacatagggtaaaattaaaaaatttaaaagtgcacatcaaatcccatctagaaattctgactaaaaaaatcaggaaactaattgccaaaatcatttattattcatacgggatctgttaatgaaggacatcagctaaatcacattaaaagaagcatcttagatcaagttaccagaaagttggaggataataagtttatatagtggtgataagacaatcatacaattcaatactgctctcaagactgcatttgcaggtccttattttgagtgtggctgctcttccaggtgcttgtgatgactaaggtgaagttctaaggagctcgaccaaagcaagatagagagaaacctggcacctaagctggacccttagaaaacttacagcatatttttaagaatttatcgtgcatgatatgcccgattatttgctaagagaaatcgtgggcgtcgacgtagagcttctcatagaaacaaaacaaaatgtatcacctacttactacaaattcaacctaaaatttagtgtgggctacacaggatcaaccagcatagcagcacagagtatgccagaaacccctgcatcaggaagtacctctgagaatgacttgtatgtgtcagactcagttaagagtgatgataggatcatacttaattgaataacgagaaaatggttgtggagcaattaaagaggtcatacgatgtagggcaaatcccactagcatgcgtgcatttcaaaaattttgtggatatgatgcaattacgcacttctaaaggacagatttagtcagtcggagacaattgaatgttaattcatgcttaagctagcacacttgacattaacatcacaggattaagactaagtgatggtttttgtgggatacaaataactgaataagcaagattcgaaaaaatagtcttggctatcattatacacagatcacatgcaagtgcagtttatattcaagcaattaggactaatgaggtttttcatattagaaatgtgatataatttcaggcttgaataaagggctcgtgattaggtggttagacgttgctcctattgaggataaagggtgataattgattgaggtggtttggccatgttcaattaggcctttaaacgcaccaacttgaagaagtgataaaattataattagtggagaaatgaggacaagaagaaggctaagagaacttgattagaagcaattacgaaggacatggcaagattctccaaccacattaacttaggaggaactgtgataaggaataaaagggtgatgcatagcaacaatgaaaagggcattgtagaaaacctttttccatcactttagcaacagatgcttgaggatgaaagcatatggttctgaaaatgaatttttttagcatctatatcaaaattgcagtttcttgcttacctgggacaggatatatacccaaccacaaattcggtggcaacaaagattgaacattttcaaaagggtgagcagaagctttccgttccaagatttcacgaaaaccttcaaaatgtttatccaaagtgtcagacgctgctaataaccaactaggtacaatatttctttccatcagtaaatactcctgaatttttccttaccttttttgaacttcatgctgatcttttggagtagaccaataagggtggttgcctcaaaagcagacttaagaggtttggggttaaaaactcctgtgcttgagttcacataaaaacctttggtcgttccggtgatgcaatatttgtttccttccaaggttgcagcatccagataaattaaatctccaacaagcctgaaaacggatcaggaaaaagataaggttttgcagcatatcgaagatcatgatcatatataaatgaagatgggagccggacaaaggagtccgtatgccttcaatctgcagaccaactgccttagttgtattgtaatagtaatcatagtatttatctccagtacggttgttcaagaagatgttgaccaatattaaatgcaagcacacataagcatggaaacactatatgaagaggataaacatatcattttgtcataatgagcagtagaaaggcagtgtgttttgccagattgtgctcagaagagctaacaatgcaggtcaagttctgacatattcaacagaccagaatctgtatgaaatacagctgatgttggaataagtttcaacgaaagaagagcatcatacaaagtagttacctcctataacttggaggaggattaaatgaagagaatgtaatgctctccacacagtagatgtccttaggtgatgatgcaatcaaattgcaaagagaaccagttatatcttccataaaacccaaaacttcaggctccgaagtttccacttttgcatctgcgagacaaggacaagtgcaataaacatattaacgtctaagtgaaaaggctttctgcttaaagaaaataataagcatgcaaaataatagtggtttgtgtgtgtatagtagaaagccagacaacatgatttttatgacagtgtgaaacaacatactgagtatgatacttcctattgactgctctaaggcctgaagagaacatgctgcaaacacacatgaaacctcacagttcaccgtaaacatcaatggcccaatgttaattgtattttcacttcatcttctccccttagatttttgggcagtccataaccttaacgaaatagggctaggagatgtgttaactaactttggttttcatatacacatgaatgcacactgagaattttgatgcctatgcagaaattggactggaagagttgtcagcttcttttgggagtgaataagagaagtgtatgtctcctacatgcacagttttatatttatatatgtatgtagatatatgtacatgtaaatgtacaagtatgcatgaattgttttatgcaaatttatgattgtatgcatgtctctgtaaagtgtatgttcatgggcatgtataacccatcaaactcatggttacaacattgatagattttagtgatggaatgaaaaagatcatttgaggtacggcagaacttagaagcagtcaaagtacgagattttttttatgcacgaatgatttattaagagaatacatcaagatgaacatgatccagaggaggaggaggtgggggtttacatcatcatcagtgtgtggaagtggttatgtatgtattactatgattttatataatatatacgttaaatctaagctcataacagaagaatccaatctcctataattttctaacaatttaattttctattgaatgactaggaaacaaatagaggcatgatgtcatcccaataaaatgaagatgagatcatctacattgtgtatcattaggtgtaaactaagcatccaataattaaaaagtctaagaaagagatcctttcttctcctcaccccccacccccaacgtggaagcggttaaagtaggagatttagtatgagcgtagatgcatacatttcattaagataatagatcaagatgaaatggatgatagaggcattccctccctccctccctccctcccatatatacacacgcacacacatatatacagatttgtatatatgtacatatatgcacataaatttatatataaaatatagagctagctagctaggtaaatatgtttatatggtaagtagataaagatgtaacatatatcagtgcatttctggagaaaggagggcaaaaaccttgatttttttgttgcgcactttcatgttgcaaggctaacgatgttgataatgagacatggagattggaaagagacagcagttctcgtgcgcgacggacatgagaccttatagatctatcatcatacaaagctgtgcaaccatttataaaagaaaattactgatcaagtgcgaagtacaaaataaaatcaaggcataagaaaaacagattattaggttgatgtaccagcaaccatctctaaggagcagccaccaatagtaatgtctgccacttctgaaatttcattgtaatcccccagatggtgaactgagccatctttagcatgtagtattaagttatagcatgtaaagaagcaggtctctggagcatcaagaagaaactgtctgatatccattacagaatctcctggactcagctgttgataataaaaactagagcttagtgagccactaaaacaggaggcaaagaaaggctccaaagaacaaagttatagttttagaactagttttacctcagctacaatatttcgtaaaaaaacaagagaattcttctcttacaagttattttccttgtcaacaatccatgttggatttacgtttgtcgataccaaatgtttgcaagtgttttgtcaagtcatactagataatcaagttctctgcagtcaacctgccagactaaggcaactaaccattgggcaaaacacttgaagcctatgaaaatccaaagcaaaaggcactactcaaatagtgtgagtcttccatttgtgtgtgtctcttgcttcctttaatgctcttatttttttatattttgtttccccgttccccaagcaatccaatagtttctatacttcttaaaagatgtgacatcctgttttatctcttttatttccatgactagaacaatgtttcttttaacagtaatcaattttacatattacagagagaactaaccagcaaatattttagagagataaataaggaaaacagagattagtaataagtacgaataaaggactaattgcatgtgtgtttgttaagatggcatgaaagaataaagaagcaaacatatagaggggatattgggtatgagcagtcacttcatctaccaaaatgagctaccaaggtccatctgctccaatttgactgctaggatggttctcaccactagtctatcacttggaagcttgtttacgagtttccacctcacaaccaccaattccatagatatccatgtgtacgcacaattacttgcatgttgatgcgaacttgcacggtagcaagtgtgtgagacgcaagagatggagaaataattgaccatgagtagttttcaagtaatatatatcagcacaaatattcattgtatcaaatttacggttaatggacctatttccaggtagcatatactagcacaaatactcatttcatcgaattcgtggttaatggacccagctaaccctatgaaaatgtgggttcaacttattaataacaatttattcaaccaaaaaacacactcaagcagtagcactcaataattaaatccagctacctgtaactctagcttttctccagactgggacttgacagggatggtgtaaaggcgaagttcacctgtgccaacaaagcaatagcattgataaatcccttcatggcggacaagaaagtgacacagaaccattcttgaaccggaaaagaaataagcaaaggatggcttgcaacaagtccgtcaaaagtaagcattattagatccggaatagaaaggacaaattttcaaaaccaacctctttacacatttaatcccaaaaaagacccattttgaagttatttgcaaaaaccgacctggtttcagccttagcactgaaaccaggtcggtttttttgaaaaggagtccgaaacttcacgggagttgaagtcccgtgaagtttagcaactgctaaacttcacctcctaaacttcacgggagttgaactcccgtaaagtttagcaatgaactcccgtgaagtttagcaatgaactcccgtgaagtttaggaagtttttttttcaaaaaccgaccagttttcaacgccaaggctgaaaccaggtcggtttttgaaaatattgttgaaggggtctttttttggattaaatgtggaaagatgttggttttgaaaatttgtccggaatagaaaagaagattacgcgataagaaacaattaacatccttttcataaatatataagccagagctctgcagtagaaatcatggaaggatgacccaacaaaaaaaaaatacaggaaccaaaaaagcacttccacatgcatcgcgagtttaagcttcaagacacgcataagcccatatgcatcaaattatgaagccgacaaagtcagctccggtgaacaagtcaatatatttacctccggctttcttggatgacgccgccacagagtccccagcatcttccttcccgtcctctacctcgttctcaactgtcccattagccgtaggattgttggagtccccaacttcactagctccaccgttagtagcttcaccattaggatctagaggcttcacattctgttcgggtggatttgaatttgatgtttttccttttatctttgacttgttagatttcccagccatctgtaggtcattgatatcagtaagaacgagcaaaaactacggtattaaaagcaaactcgcttgcttcgatcatgcatataagggaaacaaaagggaagagattgtctgctagcatctcgtgaacagttctcctaatgatctcaaataaaactcaatttttcagggtaaaaaaaaatgctagattttgtttaaaagagacggctttttcattattagtattgcttaatcaaggaaaatggcatatgaagtacctgatcaatttctacaaataacctggtgcttcctccaaaataatctactttacactaatttcgaagcgaaagaacacgtgcaaacaaaaaaaaaagccaatccgttacccaacagagttatcaaaaacaaaacgaaaaagaaaaaaattatgacattgaagagcaaaggcgagaccttttagagagagaaagtgttggtcgaggttgaagaagtagagtactgcaaaaatggcggcggcggcgggggcggcggcagagagattgattgattggagaagccctcgtcgctttgggaagcgaaattgaaaaggggctttcttcgctctaataatatctccgtaaaaatatgatttttagcttggttggtataagttctctgggggtatagttggaataacacaaaagagaggcaaattgggtttgcggctaatgatgaggttttgctagggttttggccttgggataattttagctatgggattaaaaaaaagacctattttgctaaataattagcaaaacctaccgttttgctaatcatttagcaaaaccgatgtcagttttgctaaattgggtcttcgaacacatacgagactactagtcccgtatataacaaaactcattgtggcttaggtttagtggttaattagtggccctaaacatacgggactagtaaacccgtgggttttcgaagacccaatttagcaaaaccgacatctttttggccaacgggccaaaagatgtcggttttgctaaataattagcaaaacggtcggttttgctaattatttagcaatataagtctttttttaaagaaatccccttttagctatttcttgagggtattgtggggatttgagtaatcgaaatcactaaattttagtggtttgcacttatttcttattaatgagtacttaccctctcctatcgaaagcataaattaatgtcaaagcttatatgttaagcttttgtcctgcgaatatagttcaaattagttaaggttatactctttcaaattgcatccaacatgctaataattgctgaatttgggaaagtagaattttacacataattgtgtatagttataagattctattctgctgctcctactcttagtcacaatctcgtaagatcatactttttggatgtctttaaatgtgtggaaacaatggaatcttgttataaaaatacatgagcaaggaattttttttttttaaattcatgtcatactcaatatcatttttcatgtgtctccggattctatacatatggaggaagcatttcatgtccagttacaaattcgtatttgttaggttcaaaattcataaaggattgcaaggaaactttcttgaccattaagaagtctacacatgtaattcatctcaatcttcacaataagggggtgttagtttcttttttttttttttttggatatagggtggattacaaattctaggatgaaaaagtagaattttgtaagtttatggattccataacctttgtttgatacaaaataaattttgggatattgaataccaaataatacaaaactaatatactatagtatttgtgaattcccctctttgagaaaggatttgggctagatttcaaattctaaaatttgtaatgctataatttgagtttgagacaaacaaaatacaaataataagattacatatcccgaaatattgatgtagcaaacagcattttataaatctcaacccatgttaaaaaaaaaccctatggatttcaaatcccatgatgaaatccatatcataaaatcataggatttgagtttgaaacaaacaaaatacaaggaaacttttttgaccaacaagaagtctacacatataatccattgtagtcatcgaaacattgacgcacgtcttcctcttcatcactccaataaaaataatagaatgaaagtaataaaaaagaaactctttcatcaagccagcggattcgtcgagatgcccaatttcccatcgtcctccacaatcggaagatgaatcaacaaattttaatgggtttcaacaaatgggattttgggggtactagggacgagggtgctacaacaaattttaatgagtttctaacaattacaaaaaaacttttatttctttacatcatcaaagaatctcattttattgttttctaacttcagtgcggttgatcgagtatatgcctacaaactaaggagtgctaatctattcctctataatgatgggagtgctcaagattcgttattcatgctgcagaaatactacatcattgttactatagcacagacgtttaataaattattgtagaattgttgctgtagcacaagcggggaactgaagcgtttaaaatattactgtagcattattactgtagtgttttagaaatgttactgggacacttacagaaaactgtatttgtgcacactagttgcatataagctaaaaattaatgtttgaaaacaacattttcttgaaaaagaaattactctttttcacgttttttattttaagtttttaacatgtctttttttttacatcttttgtttttataccttcatactcaagaagaagaagtttctttgcgcggcattgatcctcttcgccgctaaaattgtttctttgtataataattagactatatttttatcttggggtttgctccaacatctcaaatttgttttttctttttccttaactgacatccctggcttgaaagtagggtggtaaacgatcgaatcgaatcaaatactaagatgtttgtatttgtatttgtttaaaattatcgaattcgaatgtggactctaaaattcatatatctagtttttcgaattcgaactcgaatacttggtatttgataaatattcatgaatattcacgaatacttattgaatatcaaagtatatttattccgctaaagaatttgattttcaaatagtatttgaattcataaataaaatttattcctttataatatatgatgtatatatatttaaatcaaaattttaattagaaaacagatttaagattatttaagtcttaaaatcaggatataaagctcaagtagaaatgatatgtaggttaaaaatatgacatcatatgtgcaatatatacaagtaatatgatgtgatcaaattttaaacgaatatttaatagacaaacgaatcgaatatacatctggttaaattctatttgttagtaaactcgaatactaaaaaatatttgtttagtggtaaatgaactaccgaatcgaatatgaccgaatactttttcgaacaagtatcgaactatttgttaattatttggttcatttccacccctacttgaaagaaatgtgttagaaaatagtatgaaaaaagggatgattacttttctcatatgaaaggagttaatcttgactgtggattctgtgtgcgaagctcgcattttatacgtgtggtaatattttcataggtgattaaagagtttttacagattcccttaaaaaaattcatatctttgaaccaatcattcgattcatggaaattgctcctccaattcgtgtaagtcgtttcaaattaatccctctaattactacttaactcttgattagggagagactgattcaaaaattaggaaattgataatcttcacaaaaaaaaactgtagaaattgtaagtacagctgctcatggcaaggcatcaaccaataaacaatggcacgagcagataatccatccaccaaggaccaaatatgatatgctctagcaacataattcacaattattcagaacaaaaccattgtttttaacaacaattcatgtacaacttctttccttgaatcaaagaatgacgcataccaaattaacccatggcttcatccagtgaacacattgatttcacagctcctgctttctttacgtctgaaggagcggagatacaacgctatatagttcatgctacagacacacagaaacaacaatgaggaatagcaagcacgaggaaattataccgatgatttgtcatagaaacggctccttccactctaatctgttaagtgaatcgatgattgccttgcgaaatgcatcgttatgaaggagaaaggatgagacatgcccaccggttacccatctcacctccgagcctggccatgctcgctggagttcaatgacagagtgtttaggtatatagccatcatcctgaggacaataaggattagtaccgagaagatcacaaacaaggaatctcaaacaaggaatctcaaaaagatgggattgattgcagaaacacaccctatgctatgatggtgcaatcccatatattcaataagcatttttaagcacggcgtcacttttttatgctattatttgcttctagtttagtccagtaaaataagacattattttttgccctctaagttggtccttctcttcctgtcctttttcctggcaaattcaggtaagccatattacgtgatttccctgtgacgtctcaacctaatttggaaaataatatgtcgcaggcgtgtgccctacatctcagcctagtttggaaaataatatgtcnnnnnnnnnnggtataagtagctacactagtgcagaatataacgtgtatctgccattaacccaaaaagacatattagtaataaggtaatgcttcctgtcttctttcctggttcattggttaattacagaacaagtacttcagattgctgatagtcttaaagatattgtcaagcaaaagatttcaccataaatattacccctccattcatcaaccacttctagtgattagatgcatcataagtaggtcaaagactgaatgtgaaatatacgatgttgtggttccgctttcaatttggagagtatctaaatttagacccaggagatgttgagctcaataagcaacagattgaaggcttgttatccttctagttatatttttctagaaggtctaaaatcagatatgacaggaaagaggcagctgagaaaaatcagactaaccgtggcagcaacaaaaatgacagcttgaggatttttaggagttggaaagcgagtgacatcagtcaatgacagtaccgatcgcaaacgctccctcacttgttcaagtgtcatttctgccttttcggctgcatctgctcgaagagcttcccaagcagtggcatgctgcaagatgccttcgcagaaagctacaacagcagagtgcggtgctagaaatggcagcgtggcaacaggagtaggatgtaaagacccaaccatcgcagcatgtacaccccctggaaatatatcaaaatttcaaatactaagctttaaagaccaatttcaaaattgaggaaatgtaatttagcttggtatgagtaaagtcgttagtctagaaagatagttttttaaggagctgattgtggatacacttgattgcagatagaccccctgcagttctattgtggagatggaccctgagtgaacagatggaaccttgagtgattttttttaatttataattggcctctttcatgttaggaggtttacttataaaaaacaactttctctttctctgagggtaaaagagtcaaaatatttcacgccgggggtctatctgcaacaagaaaactatagtgcctctatccaaaactgggcagtagtacaagggatctatctgtaaaactcttaaaaattaactatggagctatttagctagttttctagtttttaatataaaggtgtaagttttggggggattgattatctgagcagaacctattccagattaatcaatttcttatttgcatatattaaagcagaacttgaacacttttcattacccatgctaagcccacaaattcccgtctttccaaaaccagcctcaacctctaaccagtgtaacagactgcgggcttcctcaatggtggctcttcctagtaacagcaagtcgctgacacattgaagctttgcaccacgctgcagcacgggacgccgctgtccatagaatgggctgcagcagatttagcttgggttaatacctacaattgccaaaaggaaagccatagtttttgcatccatgtatctagtgcttgtaaaaagagttgacaggaaacacttcccacctctcaagcaccattgttgctatattctctttcaataatggtccaccaagccgcagtcttcgttcaaatgaatggtccccggtgcctgcaaaattccagcatgccatttacccttatgtaacatgattcataaatagtccaaaagtttcaagaaaaaaactatagggaaattaatggtttatgtatctcctctttatcctatcttatttatacttcataggtcacttcaaagttcaaatctttggtgagggctttgcaaaaacatagaataaaacctaaaagaaaaaatgtcctgacaggacacaggtgtcaaccctttgtaaaaacatgaaggaaaaaaaaaggacaaatttttaaaaccgacccctttggatttttaattgcaaaaaacaacctatttcagttttatttataaaaaccgacccagttggttgaaactgggtcggtttttgaaattttttcttccaaacttcacgggagttcaactcccgtgaagttttgttatgagaaaaacttcacgggagttcaactcccgtgaagttttccaaaaaaatttaaaaaaaccgacctgttttcagctaaatagatcgatttttgtaaatattttcaaaaccggtcgttttttgtaattaaaaacccaaaagggtcggttttgaaaatttgtccgaaaaaaaaaggttgtatgcacttccaaaattacgttagtatacaaattcttacacttggttttgtggagccatatccagtgtctagattcttataagtcataagtaaaggatagtaaatgaatagattttaatctagaggaaattaagacaaattgagcatttactatctcttgactactctgacatggtgatactaatttatgcatatgtgataacaaatcccataacaattagagcatcagagcaaacgaaaataacttacctgccaagtgaaccacacaggccatcttctgcggcggtacaaattttggggcaaggaaagcaacccttgcagtatgactctcaggaggtaatgcattgatcagcatctcatcacatggagttctgaaaatgccctctcttagttgtgcatttttggtttcccacactgttttccatatgggctgcacctgactaggtggccaattctgtatagcagcgtccggaaaaatctgcttaaccatgttctccaacaaatcgagtttgctccctccccatccccttgagaaaaaaggtgtgcttaatttggttcggtgaagaaatgccccataaatgtgatccagtacataatgaataactcccaaatttactgacaccatctcggcataaaggaaaaaaaatctccgaagtacttagagactgcaagctagtctttatccaatctacacgaaaacaatccttattcttcaaagtactcgatcaaaacctgcaaatgaaagaaggcaaataaaataagttacatgctgatcaccaccaaaaagtatttcaatatctttaggaactgaatgagaatcaaatagtacaggctacagagtcacacaaaggctacagactcacacaaaacaggaagggatttcaatcttatctgacaaaatgtactttcccatgtgttgaatgtactaagttcaacatacatgaatagtaaaacaataataagcccatgaattgcgagacaactatattaactgatagagaataaaggatagatgcaaaagaaggattcagaatgtcaaacatcctgaaggatattgacagtccctcaaataatgaggaacatgcatatgttatcaactatgggtctaaacttgctccggcgacagattcaacaacaacaaacaacaaaatctttatatcaaaacttgatgactggttaaatgaatctttttctccattcgcctatcttatgatccatctcttccattaagttagcaagtatagtaattcttcttacaatctttactttttttgagccaatttttcagctataagctatacataatacatatttggcttattactaccttaatccattacatttagctccaggcacttcatcaactatgattctagcacccctaacaggccactgatgatttctatttgcatgtgtcccagccaactcaactggttctctctcatataatcctcaatggatcaaatctctaagttactatagatgccctcacttcttagttaattccttatctctaatgccctccatagatcaatgcgaatatcagtagataccacaaaatcaaatctcctattaagaaaggttttttttaaatacttcgcagccctattatatcaaaaacatctataataggtgccatcagttgaaggtttgcccttaagttctcatgtgcaattgtcgttaaacttatacatagtaccatctttctctgttttcttctttcattactaggacattttattccttaagctaggtctctactctctaatttcatcgtgtctgcaagctcaggtccttttttcctccttactttttttttttggtttcccacgaggtatccccacaccttattatggatgggaccaatccctgttcgtgtcatggctggcactggcccgagggttctttacctgctgggggattcgaacacaggactagcccgctgtcccccaacaaaagcggagcagggcgccaaccctgcgggttaccttctacattattacccacatcatctgaagctctcagagttaaccttaacttattcttttcaatttttcattattgccactccataaaagatgccctctttggtttatcaaccctttgaacttgaattccatttaattagcaatccaataagtccagattatataagaatctacataaattattgctacccaattaaactaactctctagccatcatacaaaataataataataaacacaataaatgattaaaaattgattaaaactttgtctacaaattccacaaattaattaaagtagcaaaaaataaaatttctactacattccgcagcagaagaaaaccctaattcccaaaagaaaaagaaatttttttttgcccaaacaaataaagcgaaaataacacaaaaatcagaactttcacgaggagggacgagcatcaacaaattaacagcagcaacatcaaacaaacacagagattgagaccagaacaaaacgaagatagtgtacctggatccaaatcgacgtgcattcggcatgaaaccggcagaaaaatcccacgatattcgatcgatgccgcaatctaatcaaggcaccggcatttgcactgggagccaaaaacacgataaaataaaataaaaaattccggggaattttgaggttaaacttaaaacgctgcccttcaattttataacgggagatttcgtacgagggcggaaaacgaaaaccgtgggcgaggagggtgtgtgggccacacgggaatcgctgcgagagtgataaatggggcccacaatcctttcagcgggcgggtagtcgggggccgtggacttgggtgtgtttagatttggatgttaaaaaaaaagataagggtgcgcaggcatcggagggaatctcgatgttcgaaggataatgccaccagatcggagctccaatagtaaagggaccgggaaaggtgactcaagatgtgacaatagcggttgacgttttgggtgacggacttttcaggtttatttttctttcgagtggccttttagattaagcttgtaattaggattaggacggctattagtgggacagatgttattaaaatgttcggggccggggatttgttttttttttttttaaataagaaatgaataattttgtgatagattaggttgttaggaatgaattaggtaagaagtcggataaagaattgaggattgcaaaataaattccaactcctcaaaattttagctttttaagtgtgatgaattaattggtcgcaaagaaatctcatttaagctagacaattagtacaaaatggcgaggattctttcagagggaaaatttgcaaaatagttcgtttttgctaattatttaacaaaatagaccgttttgctaaataattagcaaaatagacctcttttttgccaacagaccaaaaagaggtatattttgcaaaacagctcagaaaacatacgggactactagtcccgtatgttttaatcgcggattagtgaactcagaaaattttacaaaacattaagatgaactcagaaaacatacgggactactagtcccgtatgttttctgagtcactaatccgtgattaagttggttctaaacataagggactagtagtcccgtatgttttctgagtcttgtttttcaaaatcgacctctttttttcaaaaaaaaatgtttattttgctaattatttagcaaaacggtctattttgctaaataattagtaaaaacggactattttgcaaattttcccttctttcagaacgatgaatggaatagattaatctataccgtttatatgaagtcagagggttagcttgaaaattacagctgttatatatgtagtgcaaatcacctcactcctataggaatgggtccgataagactctttagtggaaagttttaaaagaaaaacataaagttaacatgaaaaactagcatcccactaataggaggatgaaaacgtgaattttctcctgcacaatgatttgctaacaccaatccatccagataagaaagaataaaaacatacaaatgtaccagaagacattaaaatataatccattcagagatcaaaccaaacgataaaaatgtagagatggctattgcgagatcccaagttacagtaccaacaatataacctccatccatccagacacaacttttgttcaaattgaggtatttccttaaggagaggcatcattgataccaagttattacatttcagtacattagtttacaatgatcacttcattatctcgtgtcacaagagcttgcttctcctctgatcaagggctgctgcctgcaaaacatcaaagccaaagagccttttgtgatgagcttctagcctcaatactcagtttaaccaatgttatcttaattttaattaacatctgacgatatgaacccgcgagttttagaatgattctgctactgtcacaatagttgtaagggtgggttagatatatcgatgtactagatggcctaactacttaatgcctcctgaactactgtataaatgcacgcacctcccgaatctcagacgatgttaactcttttgccctcaatttactgtcaattgagggcaacatgcgactgtacagcaatctgttacttactgccacatgacaatgtcaaccaaatgtgagaaaaaacatcgtctggatttcacaggatgacttcatagatagagagagagagagagagaggaagggaaagatttacattgcacggaattgacattgcacttgttgggaagctgcagggctgaatcacggtcaactcccgttatcggaggcccatttaagagagcacacaggcaatcctgacccagactcctcactgcattgcaacagacttcactaggcggcacagtgctaaactgggccactgctggcctgcatggcatcaactgcacaagcacagagaagaacgaggttgagcacggagactgggccgttgcaggatggcccaataggcccaatattaaggcccatgttaggatcaacaggcatatgctcgctgaacctgacttcattgatgattctataaacaatggaaaagtgcacgaggttagttatatagagatatggtgaggtgtgagcatgagggtgtcatttttagaggtttttggtggaggtggtgattgacatgagatcgagtggcaagaatttcatgaacttatggtggcggtggttgttcacgattcatgaaggtaaatattgcatttaatatctgcgggcaagtttgattaccaatcaaaaaaaataaactgatggtttttgtccttctaggatttatgaaatacaaggccaagaaccctataacttaacaaacttgggtatggcaagcaaataagcaaaagcaaatacaacatgccagaaataataattcaagaagtgatgaaacaaattgtaggagaaaaaaaacataggagtgcatgcaaactggagttctattaatacaactacacataaacttcatttactacatagaaaacattagttctaaatacaaattgctacctggtcctgaagtgagaactatccaaataatgcagtaagtgtcctaccctgatcaaacgtaacccaacctgaaaccgagaaaggggatcaaaatatgagccagtaactttcagattttcagtactgaaagtcaagctcgtaaattcattgttagaacaatacaggtcaccttgagacagtctcaacagtaaacagccataaagctaatactaaatactatcgctagaattattaacagatctctgagaatgtgaagagcaagatcctgattttaactgccagttcggtttgaactcagaatgcaaccaaattcgtctatctcaatgacataaattactcatggagcttgatcttctgggcaagccagcattgacaaagatattgttctgcccctcatttcagtaaaggaaaatgtcctttgcataccataaaatatgtgataagttacgattgtacggttgtaaattaatatttctgttatatgcaaacatcttaaccatacattattcttctttccagctttcatagatctgtaaaaaaatgtacaccctttgcatacctttttaaacctctccttttacaattttatgaaatatgcttcagattatggaggaacatagactcctaaagaaagagtgaaggattttcttgataacttgatatagctagtgatgagggcgcagagatgaagctgaaaaaagacatcagggctttcaatttggtaagacaattgtctatggatttatcatgaagtcctttggagaatggggattaccgacatagagaacgagaggtaccaccttaataccatatgatgtgaggttatttggaattctacaatttcctcaatgagcttggctatccaaattgctttcttcctaagctgagttaacatggagcaatacatgggaactcttaacacaagaatttattagaatttggattgagctatctgcaatctgaaggcaaggatgttctcaagagtaatgtagtggctgagataaggactaccattttgaactttaacatgagtgttgtgccattcaatggtagacactttgatttcatacttacctatcccataaaccttatcattgagcatcaaggcatctaacaatactggataaaaaacaaagttcaagcctcgtgaaaaagagagttatctgttaagttttgaagcagataaaagacaaatgaatggaacagattgcaaacgctgtttgcaacacaatacaatttactcggagaaaggaacctgtttggcgaccatttcttatttcagtattgactgcatgtcccttcacagttgaacttcatcttgaaccttcaattcaaattatacatttcaattagtttatttatcagcttcgtggattacatgtgattagattgccacttgcacttgtcattgttactctctcttacaataactacgtttgttcataactcgtctcttgtattgctgattatccatctcaacattcgtttcctttgaattaaaggatggttttttgtagtttttattattaaaaggtagacaacaatcaacagctaaatttcgcaacataagtgataatcgtttgttcttccatacaaattgtgcaaggagatttcatgtagtatgatattcacatatttacgataggttcccctcattagtgtagaacaaaaaccaagtgcataaggttctcccttttcattcctatagaattttcatttactgcataaataatcagcaacctactggctccaaggggttggataaaactcaaagttcaaaacagagtccaaaatatcaacagaaaattctttttgtaatatctccgaaagatcagaacagagattttacatgtacgagtcccaatcttcattaacttattaagcctaactatcaaaatagtccaaaagttccattgaatttctcagctgataggtcacctaaaattagcaagcaataaccaatcgcaaaattttccttgattgcctaataattaaacttgatcagctagtttcaaaatgatgtcattgttcatcatggacggagagatcacatgcaaggttcataattgagaacgcatttgcttggaagctgcaaggcagcattgcggtccacaccagccaatggcggcccattaaggagagaacataggcaagcctggcccatacttctaatcgccttgcaacaggcgctactaggcggtgaggggccaaatggcgccactgccagactgcacggagtaaactgcaacatcaccaagtagaacactgtggggcacgaaccctgggccacaacaggacggttgaagaggcccgctcctatagcccatgccagcagcaccagatacatgctcgctgcacttggcttcattgattcttatgcgtaataattttgatgagagattggaatcatatgaggtttattatattgacagataagtgtaagggtgttggtgccagaggttttggtggaggaggtgattgacatgagctgcactggcaagtaatgcatgcactcatggttgctggagttcaagtttcatgaagggagagggcacgtcaaatgtaagtggcctggactactggactagtcaaattttggctggaagtagattcaatgaataatatttgagccaaaataactgctcagagttgatgcaccataccccctgtatccttttcatgtttgtttaacatgcttccgtcacagttccttccacgcctacagcattagatttctttcaataaggaaagttaacaaagccttgctccttcaaagggtttggtaaggaaagcctaattaccaagggaacctagctgcaggaatttatttaaaatagattactttcacatattttgttccgtgtcatctctgacggaattgttcgcatatgctagtgttcgcctactttttttcttttttttatcacttcctcttagttttgatttgggtgattcttaactagaagagctccatttcacctgttaattggctttcatgtattttggctattccacatcaagaaagatgagaaatgatctcactggggctgactctattgttttactacttgaatggtagatctcatcccatgctagaaaagaaataacttccccgtttgtctacgtatattctgtattgaaatgtttaaaacttggaagagacttccattttggggttctctagtctactacccgagtgcaattccagtctaagaattctactgtaatttataatacatctccttgttgtaattatggtcaacaaacttgggtgtgcaaaacaaagtgaggaaagcaaaaaaaaattgtcaacttttattagatctcaaaaaatgacaataaatataaaggaacaagaacaaagaaatgaaaacatgaagaaagaaaggcattcaataaattatgttcagtttaaacatgttcctcagcaaactgacagggtatatacttgcttgtagccttgtatgtataattgtacatacatcaaatagtattcaatacaatagacattaaaaactcataggaaacatagttttagacaaaatttgttacctgttgcaccaaataatgaaactgtttcccactttgataaataagaggcccaacctgcaatcaaacaagggggaaaaatctcagtgactataaagcctaacgtcaaaatcatagctttgttgtatgccaaagacgtggacatatattcacaatcttctcaatctaaaattccaaatatagttgcgaacagatctgtgaaaaaggacaaggtccttcatttaccgcctaaaaaacagctagttattgacctgcgttaaaaaaaaagaaagaaaatatacattcttgacatgaactcctgcgtcccttgatttcactcagaaatgaaaccaaatgtccagctgtttacaatttctagaaccatcattgacaaagataaagtccgattcatgttctattaaaagaaaatgctactctaagttgataaaaaggctcagatgactttgcttatataaacaattaagacaaaaatgtttgctaatctctaattaaagtgctatctttatcgcatatacctatttcaatctgaaccacttaatgcctggccaccgccttcttcataaattacaagccatcatgaattatcaggcaaaaagtttaaagttttgaattcccattcagaacacaatgctcacacaaattttaagatgttacacttgagcccatttttaagataatatccacagcaaatatattcattgttcctaaataaacgaaccctaaaagaagacatagccttcttaaacaatcgaaagaattgaccccattgtttcatttgctcaatctttttaacccagtcagagtcaatgtattgactgattaaattagccacagttttcaatgatatgggaagccaaatgaaaagcataaatttggccaatttcattcatccagaataagaaagggaacaaattttgtgagaaagagagaatggacagcaataatttaacacagattaaggaaattgagcattacagaacaaccaagataagaaaaagacatcaaacggttaaagatttcctaaagaaagccatccagattttcttcattcataacaagaaatgaataaacttaactgcaaagaggatcacaacataaaatatcagtcaacagagattgagcaccctaacactatatcaaagcttaagccctctcccctcaaatgcttcccactgactgacaatccttcggcataattgtaactctcttcgcatgaattgcgcacggacttgtattctcatataacctaaccaaataagcccccaccgcctcctgaagtgccgccaatgctgacgattaaaacctcagatccaccttaaaatcctaagcaagcttcctcaccagtctctgaacggtaacnnnnnnnnnnnnnnnnnnnnnnnnnnnnnnnnnnnnnnnnnnnnnnnnnnnnnnnnnnnnnnnnnnnnnnnnnnnnnnnnnaagactatattttacagtgaaattattttttacaggcaaatagaacatttgatcttccacaaaagattatttgaggagaatttctatagaatggtattcacattgtctagttgtgtaaatctcataggtccaaaataaaaaaacaaatgaaaaaaaatcctctgtgcttatcgccatagaattgtcattcttacgtatataatcaccgacctagtgcctggttggataaaattcaacaccgaaactgagtccaatttttcaagtcttagccatcaatatattatatgtggtatcttaaaaagaccaagagatagatttacctaaaccgagctccgatttttgtttttagctgatcaaacctgaatactactcaaatccctcaaaagttctatcgaatctcaaaaatcaaaaatagacagcctacacaggataatcatatcagcccctgacattacctaacaatggaacttgatcagcaggtttgttaacaatgttattgtttccataagaacaatggatacatggatagcgagattacatgcaaggctcgtaattgagaaagcacttgctaggaagctgcaaagaagaattgcggtccacgccagtcaatgggggcccatttaggaaagaacagaagcaagtctggccaatagtcctgatcgcatcgcaacaggccttgctagggggtgacgggctaatcggcaccactgccggactgcacggggtaaactgcatcatgatcaagtagaactttggcaagcacgaatcaagggacaggacgggacggcccaataagcctgttcctatagtacatgctaacaacatcatgcacatgctcactgcatttggcttcattggttcttatgccaaatagcctaatgttgatgagaacttggagagatacggcgttgattatatagacagaaagtgagggaagctcttgatagaggtcagtgaaggagccgtttgtcatgagctagactggcaagaaacgcatgcagttatggctgctggagttcatgattcatgaaaggagaaggtgcatcaaatgtaagtggcctgaagtagttgagaattggttgggattagattcactgaataatcttttaaacacaataaactgattattttttttatctaggttctagctttatgctattgcaaggacaagagccctaagactattctttataattgctccaaattgatgcaatgtacagccgctatatcctttcaacatttgtttaacatgctttctttaaatttccttccacatccctgttccttcaaaggatttgctaaggagagcctacttctcaaagggatcagactcgaggaatctattgatgcaatgtgctagtgtctccctgctttattctacttcctcttaatttgagaattctacatgacagaaatatagaaatgatctaactggggatgtcaccatattgttctgctacttgaatggtagatctcgtgctaggaaaggaataacttcctcacctgtttgtatacattaccataacaaatattttaaacttggaaaagacttctgttttggtgttacctagtctagtatccaagcgacattccaatccaagacgaagaattccacagtgctactctaaaatatattaatcctgaaaaattcatgtaaagaatatattgatcctaaaaattggcaataaatggaaaggaacaggcatgcagaaatagaatttgttaccagtttcagcaaataaagaatttgtttcctactttgataatgatcagccttacctacaaccatgaaaagggggggtaaataccagtaatttgtcaagtccaatgacaaaatcatagctttggtataaatgacgaaaaaagatcagtaaatatattcctgctcttctcaacctaaaattccaaaatattgttactttctaagttcataaaaagggtcggatgacttctcaatcaaaataacaaaaacaagacgagaacgctattcattattatacaaatttccacttaaaacgcaataaaccaaggcccctgccttcgcaaagattacaaaccaccatgaacacgaaattcaacatgacctaatgtcacaaaacaagactacgttgtttcaaatcaatccaaagtatagaaacttcatggttccatttgcgaaaagaccaactcagattagagatattaggcattctaaccatcaaagaaacgacaaagatatcttaacaattaaaggtttcccaaaaagaaagacgtcaaatttcattcacccgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggtccgttggatccgttcgtaatggacggactagattttattggggtgaaggacgcggatcgttgggctttgggcggagagggctggagtggagtttggtccgttggatccgttcgtaatggacggactagattttattggggtgaaggacgcggatcgttgggctttgggcggagagggctggaaatggttttggtccgttggatttgtgcccaatgaacggatgagactttgttcagaggggacacgcggatcaggggctaatcttttcgttttgaaaatattatctgtcgtgttaaaactcccgtgggtaactcgcaatattttatagttcagattatttttatgttaaaaatataaaatgtgaagatttttgccccccttttacttggtcatcgtttccacaaaatattggacggaaagttccaaattaagaaatattaccaccctaagtaaaggataaataataggataattttttgaaataagactctttcataagaacattcactaaaatcgacctagtcgagaaaatatacattaaaatcgatctattttcagcgatatgtgttgaaactatgtcaattttgacaaaaattacttaagaaatctaagagattggtaatcatatggatattaaatgagaattaatctctacgagattctaaatcctgtagagatttctcctcatttgagttccacgggattgttaattttgtgaagtcagtttgacttataaagtgtaagggattggcaggttaccttagaagacgttacattgaacttcaggaaattgcaggtcacctttgtaagtgagggaattaaaaacaatgagtcatttcagttgaaatgcaattggttaatgaaaaaaccattgctaaaaaatccagggagcaataataaggttatttgattcaattgtgtagtgtgaacttacaagaatcatcaacaaagccaaactcaaaggagttacctaaagatatgcaccaactgatacaagagtatgaaataaatttccaggaactccctcatatccctcctaacaggaagatagatcataatattcctttagaggaagggactaaacctatctgtatcagaccatatagacatgcacattttttgaaagaggaaattgaaaaacagattgatgaaatgcttaaaaaaggtgtcatcaaaccaagtcatagtccattttcttcaccagtggtcatggtgaagaaatctgatggtggctgaaggatgtgcatagactacatgtctttaaataagtctacaatcaaggataaatttcctattcctgttatagacgagctactgcatgaactccatgggactaaatttttcaccaagcttgacttgaaatgtggttatcaccagattagaatgtatgaaccaaatatatcaaagactaccttcagaacacatcatgggcattttgaatttttggtaatgccttttggtttgacaaatgctccctcaacttttcaggttcttatgaacaacatattcaaacaattactatggaaatctatcttagtcttctttgatgacatcttgatatatagcaagaagtgataggatcacctgattcgtctgaggcaagtgtttgatatcatgaaggctcacaaactggtggcaaaaatgtcaaaatgtagctttggaaaaacacaagtgaagtatttggggcatatcgtatcacaggatggagttggtgcggatcctcaaaaaattaatgccattgttgagtggtttgcacctaaaactttgaagggactaagaggttttctaggactagcaggctactacagaaaatttattaagagttttaggatgatagcttagcctctaacaaattttttgaaaaaatgagcttttaattggacaacaagtgctgaagatgctttcaaatctctaaaacatgcactaactcatcctccagttctggcaatgtctgatttcagtatgacttttgtcattgaatgtgatgcctcggagtttggaattggggctgtattgatgcaatcagagaggcgtatagcatacttcagttttgctttaaagggaataaatgtcactctttcaacctataaaaaggagctcctgaccattatcctatctacaaaaaaatggtagcaatatttacttggaaggagttttgtaattagaactgatcatcaaagtctcagatacttactcgagcaaagaatacacacatgcattcagaataagtggcttgccaagctgcatggatttgactacaccgtggagtataaacctgaaagattaaatatgactgctcatgggttatccaggatctatgaaggtgaagaagcagtttcaaaagagccccttgaagttccagctatttctactatccacaatgattggttggaaggagttaagctcatgtgttccacagatatattattcaaagagttggatgacaagttccaaacatgacgattaccagctgaagactattacaagaaggaaggggtgtactattacaaagacaaaatttttatcagtcctaatgcccaacacctcaaaacttctctactcatggaacaccatgatagcccttctgcggggcattctggaattacaaggacactacacagactaaggagagctttttattagaagggaatgaagagagaagtttaaatgtatgttcaagcctgtgatggttgccaatgagctaaaggagagaatgttgcatcatctgggctcttaaaaccactgcctattccagattatatttgggaagatttgtaaatggattttattactagcctgcctaagagtagaaacaaatctgtcattcttgtggtggttgatagattgacaaaatatgctcactttttttgcactctcacacccatatactgctcagtcggtggctcaatattttttaaaatgggtattcaagcttcatggtatgcctaagtctatcgtaagtgacagagatcccttgtttacaagttcattttggagagagttgttcaagttgcagggaagtcaactttagtttagttcttcctatcaccctcaaactgatgggcaaaccgagataacaaataaaaatcaagaggcctctctaaggtgtttttgttgccacaagcctaaagagtggtgtcagtggctatctattgcagaattctggtacaataccacttggaaggtgtctactctagggctgtaacttaaaaaccgataaccgaaaaaataaccacaccaaagccgaaccataaccgaaaaaaccgaggaaagaaaaaaaccgcaccaaaccgtaaaaaaataaccgaaaaccgaaaggtttggtgtggttttggtttcagatgtctggaaaccgaaaccgaaccgaaaaaccgattatatatattgtaaggaaattatattatttatagatatatattattaatatacataaaattttatgtagaaacttcaaacttgggcttaaatgaagcccaaaaaaagaatggtcttagcctgtgttcaaacattactacatagtctacattagactttaattatatttctagggcttctgagaatctgagttcttgtccatcgcccccaaagtcccaaacccaacgagcttttggtccttcgcgctccgtctcgtcccctctcgacgagcttttggtccttcgcgctccgtctcgtcccctctcgtccatcgccctcaaatctagggttctccagtccatcgaccccaaatcttgggttcttttgtcaccggcgaagaaatcccttctgttacgtggtactgtagcttttcctttccccaaatgttggtcatggaggagcttgttgctgaacttgaagtgctgatctatcatctacatgtttctgctattctagtttttcatcgctttttttttcttttcgaaaactgttatgtggcattgtgggctgccctttttcttttttttttcttttcttttcttttcggaaatggttatgtaatatgagatatttctactttctacttttctagacttgttttctttatagaataaccgaaaaaaaccgatataaaccagagaaaaaccaaaccgaacacaattggtttatgaaaaaataattgaaaaaccaaaccgaaccgaaccgaaaaaatagatcggtttggtgttcggtgtcacctattaaccgcaccattcaaaccgattaacagccctagtctactcaaactactccctttgaggttgtgtgtggaagacctcctccttctttgctctcctacattcctaaaagttgtaaggtgcaagcagttgatgaggcccctttctctagagatatagccttgtaatttccgaaggatagcttaaagggtgcagctaataaaatgaagaagtttgcttatttgcacaggagtaatcggagcttcaatgcgggcgactgggtattcctcaaacttcaaccctataaacagattagtgtctcctcacacaagccccataaactatctcctaagtattatgggcattatcaaattctggaaaaaataggagaagttgcttacatgtggctcttccagaacaagctaaaatccaccaagttttccatgtttcctaactaaaacgaagaattagagctgatgttattcttcaggttgattttcctacctatgtggaggagagagtggatgaaccagagaagattttggatagaagatcaatcgtgaagggaaatagattaatatcacaggtcctcatcaaatggaagcagcgtgcacacttggattctacctgggagtcttattgggatttggttaagaggtttcacacatttgacctcaagacaaggtccaaattaaggggagagaatttgtcagggaccactgcttccaatgctacgtcaaggacaaatacaaacctgtcaactataccgagagctgctaacctgtcaattgaggacagatacaccaacagatatgcaagttgaagggttgctgtgcaagattagaagcttagggggtttatctgcaagtatttgtaactactaggatcctaaataaatacccaactcagcctaactgttttctgttttcggttaagtctgttgagctctgtgcacgtgcacgaacagtgtacgtttgttttctttgctttattgaagagagaattgcattgtataaatagtgagatgaatcattatgaatgaaataagctgtttctctctgagctcttactccgtgttcctcaattctctctcaaatctttctcaactctttctcaactctttctcaattctatctctagcaactcttcttgttcaattcatgttcacaatggacagagacatagccaagaggttcaacaaaggattgagatcatcacaattggaagctgaagctgctgctacagaggattccatggaggatcacgaggaaattcttttgattatttgactattggattcaattgtaaagaagatcaatgcaatatttacaataggaaagcagaccatggagatcatggcaatactcaaaatatagtgcaaaatcgaagtgcccaccgtagatagcgttttccttttgtataaattccataaattgtaattaccataatacttttcctttattgttgctattatccatgattgatgggaatcatgtttggtaggttttgcctcatatttgtatttaaacattgtttataaatgagaaaacttcaaggtgttcatacaatatttatatcaccttcattaatttcttcataaaggatcgttttgtttgagtgtctagttcaaatttgagtagtttttaatttataataattaatataggaaacgaaactagaaaaagtgatgaaattttaataacacataaattgacaaaaaataatgacctcatgtaaattattaatttcaatatatacgtgcagccgtgctccgtatcctacatctcacaaaattattatgtcatgtatccgtacccgaaccggaactcgtatccgtttccaagatattatcattgaacaaataacatattttccccactccacataaacatatattcaatctacaaacaacttacagggatatgtaaattattttaaattactgaaagttaatctaaacatgatagaaattcaaatactcgatctaaacatgtttagaaactgaaaaatataatctatatcaaaacggaagcgtaatagattaaactaacctccagccatcgttatcttactcaaggatatggatgttgatttcgaagatcttctaaaccttatctcttcacttaatgatggtgtatttttctttcaaaattgaagagtagatctagggacccgaaatctgtatgctccttttatactctctccatcaaagagcaacaaatggaattagtgggcaaagtggtcggttaattcataaccaactctcttgatgatgggaagttattggaccaccatgtggtaaacgaaactaacattctcccacttggtccaaacattccatcatcttccttaatgaaaaacaaaatacatgaatcatggtgataggttctctaatgttgagtagtatcttccatgtatcacaatgtatcgtgtctttcaatcccaaatgacttaatgaataaaccctatgtttattcgaggtccaaactttaatgatatttctcaaataaacaaatatgtatgtgcacaaaaaaatgagaaaaataccaactgaataagagtttcaacaaaatatcaaatgtatgtacaatgaatacttacatcatggaaccaagtcccattcttactacatgatccttgaaattctttggtggcatgcctttaatcaaaggatcagcaatcatcaactcagtgctaaggtgctcaatgaccactttcttttccttaacacgttctctaatggccaagtatttgatgtcgatatgcttactacgactaccactcttgttattcttagccataaaaacagcagctgagttgtcacaatacaatcttattggcctagaaattgaatccacaattctaagccccgacacgaaactcttcaaccatacaccatgtgacgtagcctcaaaacatgatacgaactcggcctccatagtggaagtagcagtcaaagtttgctttgtactcctccaagacacggctccatcggcaagcatgaaaatgtatgttgatgttgatttgcgtgaatcaacatagctagcaaaatccgcatcagagtaaccaaccaactccaaatcgtcggtctgtctatatacgagcatgtaatcctttgtcccttgaaggtatctcatcaccttctttgcagctctccagtggtcaatacctgggttactctgatatcttcctagcattccaacagcaaatgctatatcaggtcttgtacagacctgagcatacattaggcttccaatggctgaagcatatggaatggttttcatctgttcctgctcgagctcatttttagggcattgatttaggctgaatctgtcacccttcacaataggtgctacactcggtgaacaatccttcattcgaaatctctctaaaaccttttttatataggtctcttgagacaaacccaaaatccctcgagacctttccctattgatcttaatgccaatgacataagatgcctcacccatatctttcatatcaaagttcttcgagaggaactgtttcacctcatatagcaaacttttatcatttgccgcaagcaaaatatcatccacatatagcacaagaaagcaaaacttgctcccactgaccttctggtatatacattgatccatgacgttctcttcaaaacaaaatgaagtgataacatcatggaattttaaataccattgacgagaagcttgctttaatccatatatggacttattaagcttacagactaagtgctcaccattactagaggagaaaccttcaggttgtttcatataaacttcttcctctaggttaccattaagaaaggccgttttcacatccatttgatgcaatttcaaatcaaaatgggcaaccaatgccataatgattcgaagagaatctttcttagatacaggagaaaatgtctccgtgtagtcgattccctctctttgagtgaatcctttggcaacgagtctggccttatatctctcaatgttgccttgtgagtctttctttgtcttgaaaacccatttacatccaatggctttcataccatcaggcaacttgacgagatcccatactcggtttgacgccatagaatccatctcatccttcatggcattgtaccataagtttgaaatcttagaactcatggcttgtgaaaacgtctcaggatcattttcggctccaacattgtagtcagactcttgtagatacacgacatagtcactaggaatcgccgatttccttactctagtagatcttcttaatgctacatcaacattttcctgaggatcaggatcatgttgttcagctggttgttcaacagcttcaggtatttgttgaacttcaacatctactgaatcaggatcatcagcttgtggtatttcgtgaactggttcttcaacacgcgtttgaactataggcgtgttgttaacaacaacgaccagtccgttgcttgaagtggcacactgagcatctaaatgatctttctcaagaccaacgcattgggatcgatcgctcccactaatcaagtcattctcaagaaatttagcatttcttgattccacaaacctagtgctatgaaatggacagtaaaatctgtatcccttagaccttttggcatatccaacgaaatacccacttagggtccttgggtccaacttcttttcttgtggattgtagactcttacttcggatggacatccccaaacgcgtacatgtcgtaaacttggtttccaacctttgaataactcaaaaggagtttttgagacagccttggttggaactcggtttaatatgtacacagccgtcttaagagcttcagtccacaaggatttagggagtttggagctagcaagcatgctgcgcaccatgtccaataatgttcggtttcttctttcagctactccattttggtccggagagccaggcaaagtatattgggcaacaatcccattttcactaagaaaccttgcaaatggaccatttgcatggccactctcagtgtatctaccatagtattctccacatctatcggatctcacgatcttaatttgtttgccacattgtttctctacttctgctttaaacaccttaaaagcatctagtgctttattcttactgttaagcaagtagagatacatgtatcgcgagtaatcatctatgaaagagatgaagtacttatcacggtatgcaaccatgtctggacaacaaatgtcagtgtgtatgatttccaataattcagaacttcttttggcaccttttttggacttgttagtctgcttacccttaatgcagcttatacaagtctcaaagtcagtaaaatccaaagtaccaagtaccccatcatttactaaccttttaattctatcaatggagatatgtcccaatctccgatgccataatatagaagattcttcattcacaacacatcgtttagtaccaacattttcatgaacgtgcatagaagtatggttttcatcattttgcaaattaaggaggaaaagaccatcagacaaagtaccacatccaataacatcagatttataagacaaattaaatccgaaatctgaaaagttaaaggaataaccatctgatacaagtctggaaactaaaattaaattcctagaaaaactaggaatataaaacgtcttttctaaacttaaaataaaaccactacttaaaaccagtctgcacgtgccaatggcctccacatgtgagggcatcttatttcctgaatagacgctgtgctcacttcccatcggcttccgcaggtctcgtaaatcctgcaatggattggtgacatggattgtagaaccagaatcaatccaccatgtgttatgattagcatcaatcatattggattcataacaaacaaaagaaagttgagtacctttcttatcaagccacttcatgaacttggagcattgtttcttaacgtgccccttctttttgcaaaagaagcacacaatctctttcttaatgtccttttgaggagggattttccctttccccttgtccttggcttgatccttcttcttgtactttcccggggtagtaaagttcacaatttccttttccttttccttttccttttcctccataagcagcatgccctcttcctgaacacacatggtcaacaattcattgatcgaccatttgtccttatgtgtgttgtaggatatcttaaatgggccatattgctgaggtaaggtgcaaaggatgtagtgaaccaggaaggcttcagacatctcaacctctaatacatttaactgagccgcaatgtccctcatgcgcatgatatgatcacgcacaccccttacgctggtgagcctcaaggatgaaaactgtatgatcagggtgctcgccattgctttgtctgaagtggcgaactgctcatcgatagcctttagtaaatcttggaccttgtcaacctgctcgactgaaccccttataccagcagaaattttagtctttatgaacatcacacagagacgattggatcgttcccatttttcataaagctgaatttcgtctaaagtgctgatttcagtaactgtagggggttcaatcttccttatggcatagtctatgtccatccatcccaaatgaaggagaactctctccttccacactttgtagttgtcccctttgagttcgggaacatcacatttcatatcagagtaattagcaggtggaattgctgcaataaattaaataatcatgctcatgttactaattttgaagctaacaaaatatgacatgttctaccaatgtaaaaacatgcaaatatataaatatagtgacataaaacttgcctgtgggctaaagttccaattcaattagatttatcttaacttcatgataaaactatcaaattattctttattccctaatccctgtgggtaaattagaaaatataatttgacattttaccctaattaattaaacagatataataaaaattcatgtgggataaattttattatatcacatccgattaatcacaattaatgtttactcttctaaataagatccttaacaagtgatataacaaaccttattgtacagttttaattaattaaggatgctgtggctactcccaaattaattaaactatatggtttaattaaatagtcatttaattatattcacaggaaaaatcacttgataaacgcaatggatctaacatgcatgaaaataaacattaactagaaattgtgaaatacgtaatgtaggcaaaaaaaaaaaatcgaaagcaaggaaaaatattttagaattcaaagagacccaaggcccaaggcccatcaaagactttttaatatatggtgtagccctaggggtttgaacaccaaacctctaggccaaatcctcaagccttaccactaggccatttcccttaaaatatttaatacaatcaagatatgtatagatattgaatgaacagatccgaattgttaattaagcaaatcaatttgattatcattataccaagatcttagaacaaatgattttcacaacgaacaattaattaagaaaaaacgagaaataaatattattatggaaaatcataagttctacaaccaatagctctgataccaaatgtaaattattttaaattactgaaagttaatctaaacatgatagaaattcaaatacacgatctaaacatgtttagaaactgaaaatataatctatatcaaaacggaagcgtaatagattaaactaacatccagccatcgttatcttactcaaggatatggatgttgatttcgaagatcttctaaaccttatctcttcacttaatgatgatgtatttttctttcaaaattgaagagtagatctagggacccgaaatctgtatgctccttttatactctctccatcagagtgcaacaaatggaattagtgggcaaagtggtcggttaattcataaccaactctcttgatgatgggaagttattggaccaccttgtggtaaccgaaactaacatagtcatgaacatacacctacaagcaaaatatcttcagcactccggcccaagtaagaaatctaacacatgtataatgactgcgctgttgagaacattgaggctgtttacctacagtgttcacctacccctgttacagtgtttacctaccccaaatattgttcacctattctctattatagtgttcacctatccccatgagaaaacttataaatacccccctaaatatgatttgcaaagtatctcaatagcagacagagaaagggaaagatacatatataagtaatattattaagagatattgagagagagagagcttgtgagaattattggagagtatcttgatcaagaaagggtgttctcttttatctttttattttctaacctcgaaatgaatataaagaaattgggcgtcgtcgttgcatcgtgaagtagctccgtaagaacgaacaacgttatatctgtgagtattgtgattgaactcgggtttgttggttttattctgtgattccaagatcatttgggtatgttttgcgtctccgtttgaggcgttcttgttggcgtgtaccctaacaagcgcaacctcttgaacctcaataaaagttcattaacatcactttttcccttctcatcactcaacctcaatatattttgaatcctcaaagcaaaatacaacaataatatttatgaacttccaacggaacaaacatgaatatcaattcagaaacaacaaatcatgctggcattacaattcacatccaaaagacagacaaaattctgcctaacaaatcaaagaatacagtatcctaattacaacaattcctctcaaacacttacaacctaacttctttcaaaactccagagccagttggaggtctagcaactgcacgatgactcaacaaccggctcctgccccggcacgacaatattagtccccttaagcaaagaagaaccgctccctccagcatcaggcccatcattcgccacaagcaatttcttactcacaatacgataaatctcagtaagtgcggtaagaaatgcagtctcaacattagtagcatcaagagcagaagtctccatgaagaataggttttctttctccgcgaattcttttgcatcttcagttgggactgctcgtagagttccaaggtcagatttgttgccgatgagcattatgacgatgtttttgtcggcgtggcttcggagttcttcgagccatctagctacgtgatcgaaggtgacacgcttggtcatatcgtagactagcattgctcctactgctcctctgtagtatgcacttgtcacagcccgatacctatatcagcgcaaagcatagctggtggtttcagtaatacttatccgttacataggttaataacagttttacataatctagcatggaactctggcattattaattaggcacaaacttatatcagtagataataaatgcatcagtttaattcagaaaaagatacattaggctacagttagaaaaacactgtatataaaaactattttggttatgaatcttatgattttttcttgttcgatgaagtttagtccaaatatgtacaggagttaatgtaaacagtgagagaacaggtcatggaaccgaatcatgttagctgaaaatataagataaagtagctaactaaggcgtacaagaatttctctccgttggaagaaataactgatctcgaaacgacaataaaccatggggaattaaatgccacgccaaacttaagatcctcatgacagtgaaaaattaaacctgatgccgagttttcataaaagctataaacttttaaatgctttgtcacttcaaagaaatgacaatgggtattaaatgccatgccaaacttaagatcctcacgacagttaaaaactaaaccaaacacggagttttcataaaagctatcaaagattaccatatctcaattaaacaaccaaggcaactatcagagttcccaggtaatatcacagtgcatcaacaaatgtgtaaccaatgacttttagatcgagttaacttgctagcaaaaactgaaatatacacacatttataggtttttaggacgaactacgctgttcaatatgcaaaatatagatttcacgtaagagttcctgtaacaccagtatcccagtatcccatatttcataatctaagaaaatagagcatacataatgccactacaaacttacccaaatcactaaccatacatgttcagatattaagtaggaaatggggacacaaacataaatacattgattactacatagtaaacagaatgtatccctatgtgttctcatagacatgtaatgcatggaaagtccaaagacactttctaataaataataatgacaatgtttacatatatgctaaactttgaaatgtccatttccatgtctttccagaagacatagggcttgtctcttgactttttatgcaataattcaatgcatttcacttcttataccgaaacatatctaaacttatgtcgataaagcaaagatttcagcatgccctttcaacaaaaagctggtcttcaagaattccaaattacataataaacagtcactttaattttatttttcataaaactcaagaagttattaaatcattgaagcgaacaaaaggttatcagtgaacgaggagtagaaaatcaatataaaaacctctaggctatcataaagcaaaataaaacttgaagatcaggtagactagaaattatttcctttcttctgacacccatttcctcaatacttgtcgttgacatcaaaaattacaatcttcacaaaagaaaagccattaacaatttgctaatgtcctttacatcatcaagcaacagcaaaaaatctggattttttctgttctaaatcttaattcaaatggtcaaatcatatcgatcactcagcataaaaaaaccataattttcaatatcttcatcccaaacaatcaactctagtatccaaagaaaacacaacaaaagaatctcgtgaatctaatcataaacagcccaacatatattaatcattaatccccaaatcacacaaaaagctaaaagtactcaaatcacacagtgatctgaggcatgaagaaaccgcgaacgatttgttgaagaacaggttttgaagactgcaggagtcacgtttggagcttcacggtcgaccgcggcgtaaggccggtcgaccgcgaacgtgcacagactctgggaggagtctggctttggcacggtcgaccgtcgcggtcgaccgtcagaccctgtaggagttttccaggctctgtcgtttgtcgcgatcgaccgtggcggtcgatcgcgtatcgggtcaggcccatgattggtttcctgttcttattgggttttggtgtttgctataaataccaatatacgaattaaggtttctttgggctttgattggagattggttggggatatttggagcacagaaaaaagagagtttttctgagcaattgtttgagggtttatttggagagattaagagctttgttggtgagattagtttgttccttcgagtgatttataatcttaagtttgtactcttcttctctattagtgaaaacccaatctccttcttgccccgtggacgtaagtaatttgccgaaccacgtaaaactattgtgtttggatttgtgccgttgttttgatttgtttggcctttatctcgacgtttgtttgatttggttctcgaagcacgcctatttggttgtcccgctttcgtgccgtgcacaacaaggcagacccacaagttttcacataacctaacagaacttacctataatactataatatcataacaaaataattgccgcttgttgcaggaatgagacacatgtcactatcccctcagaatatatatcattcatgcattttagctctcatgctatcatccatacatacctcattcgttattaagatgatttatctcaaaaatagataaataggtatctatttccctgttttaagttttccatgagaaaatgacatcaataggtgttcattttgaatgaatgtttaatcaagtcatattattaacaagctaaaaggaaatttttataggacggttataataccaacaatgttttatgggtcagagtgttgggcaattaaaaaacatgtgcaaaaaatgagtataacagaaatgagaataccgcgatgatcttgtggctctaaactaaaagatagagttaaaaatgagtgcatctctaataaattagatgttgctcctattgatgataaaatgaaagaaaatcgactaagatagtttggtcatgtacaacggaaaccacttagtgcactgattaagaaaagtaatgaggctagaagatctagagataaacctaaaagaacttggttggaagcaagtaagcaggatatgattatgtttaacttaacggaggagatgcgccataatgggatgagatagaagaatatgatttatgtagtcaatcccaagcacttggaataaaagctttgttgttgttgttacactattaacaagctaacacaagcacaacaacactttataccaagtctcatgcaccgcgcaggtaacaactagttttaatctacaaaagcaatgcaaaaactacatttggctccgtttggatactatggtgttttccttgtttccatggtgtttttgccaaaaacaaaacacaatgtgtttggaaaccatggtgtttttaagctaaatcaccatcaaacaaaaaacacaacacttatttcaaaacaccttttaggtgttttaagtttgatgttttggttttgagtttgagaatgtgttaatataatatctaacataatatattaaatataattaatatagagttattatcaacatgcttattatattatactatacaccatactacattatagttaatttaatatattagtaatatttattaaataatatcaaaatataataaataaaatatcttatataataatattaacatattaaataccaatatttaatatgttaataatgtattatataataaataaataataataaatataaataaactaaataaaaataataaaaaagttattgataataaataataatataataattatataaataatatattatacaatagtataatcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattattataaaaatattaatataatgtacaacaataacaaattcatataccaaaataattaaatatataattatttgaaaatagtatgtaataattataatataataataaatataatataatataactcattaaagtataatataatattataatacattatacaatattatattgcattacatttaatacttataatactataataatgtaaactaaatattataatattttatttataatatattttattataattaatatagaatatattaacaatatttttaatattaatgttataatgagtcaaactagtgttgatcaaaaatacttaacatgatgttttgaaatcattttaagggaaaaacacaacatcatggtgttttttacacaacaagaaaaacacaatggtatccaagtgaatgaataaaccactacaattataattgaaaattaaaaatagcaaacaaccaaccacaacttacccaacaactcaaaagcaaccattaaaaaaatagagaaaattaaacaagctatcacctttcttgaccggcggtatcccaaatctgagccttgacagtcttatgatcaatcgcaagcgtccgagtctgaaactcaaccccaatcgtagccttcgagtccaaactgaactcgttcctcgagaaccgagcaaggagctgggatttccccaccgccgagtccccgatcagcaccaccttgaacacgtaatcgatcttctggttgaaatctccgtgcaaattcgccatcagctaacaaaacgaacagaaaccctaatcgatcgattggttgcgggggctagggttggatcgtcatgagatatccctcgatctctcactccctgtctctggatttgatcgattctttgccgattttggatttcggggggtgggattgagaaattagggttttgaaaatttggaaaggggatcaagaaatgggaattgggaaatgagtcatgatctcgttcgtgtccatgacatgcatgagagcgcgaggggaaggtatgaataaaggcttaatttcatataagccccttaactttggcgtgtttcgcataaccccttaaaacttcgtttatcttgcataactccctaagattaggcgcgtctcacaaaatcacgcttaaatttaacgttaatttttcctcagagtaaaattttagttatttttcaaattatacacaaatgagtctggtgagaaaaggttaaagctcagagaaattttgtgaggaaccccaaagatttcgggggattgtattagataaacaaaatgggaagggtttatgtacaacacccgccgctttggcccataaataagcttttcgacttttgcaaaacataccctcaagttccaacgaacttgtgctttagatttcattattttcagacgaaacctttggtgaacggtctcggcaaactcgacgtctttggaggtgcaattggatgtgacaaatcaatggtccagtacccgacccattaacatgccctcttagacccgacccgttaaccaccctttagtctatcgataaccgttgatccctccgctcttcaaaaataacccaaaaataataaggaaaaaaaaaacaaagaatgctcaaaaccagaattctcatgagagccctctcctccctttcccgccaaaattcaaactctcagtgtctactccccaacggtcaactagaggatgcgcttgtaaaaatgtccacggtaggattagaattagattttcggagctacgattctgtcctcgacgcatgcatgaatggaagggcctatagagagggtcaacgggtccactctcatatgaccaagacccgttaccccatgcaagtttacctcaacacaaggcttgtgatcttctatgtcaagtgtgatgctcttgacgacgcacgccaactgtttgaggaaatgcccgggaggagtattgtttcgtggactgcgatggtatcagggtattcgaaaaagggtcttcattcggaggccttgggtttattcgttcggatgatggtgacaggtgaattgagtcatattgtttgatattgtatggttatttgcacacccaaatagttattaatcattttcatatattatacgccacttcacattcgtgtacaacattgctcgtcatatgctaattccattttcattgaatatagtgaaattataacgttaattgcacatagacaccttttagtatctttgttttgcacttactgcccatgtagtcttgttattgcagatgaacccctaggtctaaactttttgactcttttacccttggcgaaatttcggcaaatattgcccctaagtgaaattagtgagtctatctgatggtaaaatagttaaaaaaaaaccacggggtctatctgctgaaacgacagatgatgtaactttaagacaacaatagtacatggggcctatgtgcaattaacccaagattatattcaatggtactctcaatgaagttgaccttgtaaagtgtgaatattgaaagtacataaaatggtattattctcagatctcttaccaaatcaacacactttggcttcaattcttacatcttgtgctggtctttatggcctccagcatggaatgcaagtccactccctgtccatcaagctcaacttcgaatcccatatatttgttggcagttctcttcttgatatgtatgcaaaagctggtgaaattcatgaagcaagaaagatattcgaagaccttagtgaaagagacgttgtctcttgtactgctattatttctggttatgcgcagttaggcctcgacaatgaagccttggaattatttcgtgagttatataaagagggtatgacatgtaattatgtcacttttacgagtcttttgactgcactctctggcttagctgctgtggattatggaaagcaagtacactgtatcacaattcgatccagacttccattttatatcgttcttcagaactctcttattgacatgtactcaaaatgtgggaatcttatctattcgaggagaatttttgataaaatgtgtgagagaagtgtaataagttggaatgcaatgttagcaggatatgctaagcatggactagggaatgaagttatcaaacttttcaattccatgagagaagtattgaagcctgattgttcaacgtatatggcagtattatctggttgtagccatggtggacttgttgatgaaggtttaagaatttttgatctcatgactaaagatgaagaggttcatcctgaaattggccattatgggtgtgttgttgatttgttagggagggcaggcagaattaatgaggcttttgattttatcaaagatatgccatttgaaccaacaatagctatttggggttcactgcttggtgcttgcagggttcatgttaatgtttcagctggagaatttgtagctcagaggcttttacatctggagccagagaatgcaggaaattatgtgattctttctaatatttatgcttctgcaggaaaatgggaggatgtgatgcgagtgagagctttaatgaaggaaaatactattatcaaagagcctgctataagttgcatcaaattaggtaaaataaatcacacctttcacactaacgatcgatctcaccctcaaaggaaagaggttgaagccaaggttagggaaatatatgtgaacataaaagaagctggttatgttcctgatttgagctgcatattgcatgatgttgatgatgagcaaaaggagaggatgctacttgggcacagtgagaaattggcaatagcatttgggttgatgtggagttctcatcatgggaatattcaggttattaagaaccttaggatatgtgttgattgtcataattttgctaagtttgtatcggtggtttatggaagagaactatcgttgagggatagaagtcggtttcatgtaattgtaaaagggtcgtgttcttgtggagattactggtgattttttgaaagccataattctaccaaactctgatgattttaaattgtggaggaaagatagagaaagagagcaatcctcgacaagatcgaggtgatgcacattgtgatgggtctatttcacaggcagcaaggcacttagtaccttcgaccaaaggactatgagagtaggtaaattcttctacacatttttcagatgactatatttgttcaattctttctatgtaaatctaattaatacattgactattgaatatacatgattggccaagtttgagcaattcattgtgcatctatttccttcatgtcaatgaattggctccaatggttattattttaatgctgcatcgatttttttaagtttacacgaaagcctttacattgtgagggaattgtaatatttgaactgtagcttatttgtagtggtgttgaaattactggaatcttattttggctcctataataaggagcaaaactgagttaactaacctattgtaattaacttgtgaaagtcatgatcaaatatagttgatatttgagtatttttacaaatgcctgtgaggagattcaagttaaaagtttctgttcactagtttattctctccaatgtggttgttgcgaggaatgtttttattgctcgacgatagaactgtattaccacctaggttgtatatacttaaaattcactaatatttagcctctacaacattatggggttgttactagtaatatttgtgttactcagaagataggactgcttttgctcttaggttttatgcatcacttaaaattcataaatggttagcctgtacatgtttatataatggacagagtgaactattatagcatgtacatgtttgtgttgtggtaaacaagaagcaaatatgtactggttgtactctaatcacgtcgactggtatgtgatcgtatatttgctctaagccacgcaagcatgcagagagcagatataacaagttctattcaagctggataaccatgtctctgaacaattaacaccaaggcaagacacttgcgtgtaactgagttccacgtcgctagtctggatgtttggcgtgaatcagccctgtttcttgtcttttaaacaagcgagcataactcagagacatcccttgcacacaacaatagtgatctagcacaaaatagatctcaatatttggagttttcattttagtaactcaactattgtcaggttagttggaatttcattttatgttatctttcagttagagtttcagttagagtttcagagtatagaaataagattttggagtgattcgatagggatgaagtcaacgaacatgaagcaaggtccggttaggtgctgtgagtgaaaccagaccttcagcatcacatagtgtaactcataactgaagcaacatatcagcttaccaagcaacatcaaattactgaaagtccagtgcacctcctatcattttggcaaaattattgtaacacttcaagaatagtcgaacttaaaattttaacatggagctggagtggccagttctaactctattatgcagcttgagatgcagcacacaaaccaagcaacagaagcaaacatgacactgcgtttccctttcagctccttttttgctcatcataagaatgtaatctagaaacaaaataccgcacctcttttacaaccaaaataaagctatcaaaacacgtacacctatgaaatgtcacctgaaactactgatatcagctctcgcagcctgataatcaactaacgcctctagcaaaatgaacttcaagcaacattaccgaaggaaattgattagtgcatatgattaaaaaaactcaagccaatatataatccaaaaataccagagattccaaacaccagaattgcttaaaaattgacaaaattccatcagaaatctgaaattaaagtctatttcactgctaaaattggttcgaaacaggtatgggactaatttagtctgtttcatcaatgaccttggttcccaatcccttgagtccttcaggaggaacctctgcaactgtgaccaacgagtagagctcttccttggcatcctcttcttcgttcctcttgcgggcaatccttacacgtactcgccttggaacacttcggatgccacggctccagatgtgcttgttgagcttcacgtcaactctcacatcggttgtccccattgccttttgagcaaatttcctgatctccttaattgccttgggagccatcttcttgaaagtactacaacagggattcaacaaaaaatgaagatatcagacttagagaaccattggccagttggaacagctaaactaatctcaacatacaataggaattacattgtagaagggattcctacaatcaaggaaaaagtaaaaaactgtgtcaaattagcttcatttagagtttctgatatcatagttgccaacaaaaagttttattaatgtttggagtattttataatgatcaataaattaaatcaactagatatgatcctgaatggcgagaacttacaagaaatttcacttcaatttggatctaatctttgttaaccaaaaggttgtcagagcacattgcatggagattcaggctaattgctaaatatacaattcagaggaaataatttgcagctatcaatacaattacagatcatgaaaaatattaggattatgaaaatcggaggaggtgacgtatacattctgacccaaaagaaagacacattccattctataagataaaaaaaatgcagcagtatttaggagaatgtaaattgtttaaatgccagttttgacattagcgtggcatatgagccaagttctcgagtgtttccagagtcgtggtaagttttagtcttttagaagtaaacacagatattgacgcacacaatactgatcccagtgggtcgatatgttttgatgccatttctaccgagaatggcatactaaaataatcacatcactgtttgtagcataatatgcattataaagggaaaaacaagtgcaaagcttccagtatacgtttggatccttcaaatatcttgattgctattctttactaatgtttcgtctaacacaagccatgtccaggtatcatgtcatttaccatatcaaatacggaagaaaggtgcaaatgtacagagttaggctatcattgatatttctaaagctagacaaaaaaaaacatcagtattcttttcctttggtttggggtgcacggaatagtacattatgggctcatcttgagaatgaagcatatgtatgacgggtgtttgcgtgagcgggtttgattgcaggagggtaagcattacattgtttggtatttattcctggtattgtttcttcatacgcaaagctttctacgtattaatggcaacaattgtgaatatagtcattttctctgtgccctgaacgaaacaaagaactacaaaggtatcagatatatgatagaatccttgtccccaactacgaatcaataacgggtcaacctaaaagaccagttaataatttggtagtccatctccaatcacactaatttacttgcaaagccatgttaccctacattctctcaaaaataaaacccctcaataatccacatactggaaaactataaattttttcacaatacatactacacaatcagggctagacccaaagattcttcacctcttgtaatatattaacatcgagcaaattctcgaactttagtttatttgagtagcatttcaatgctaaatctttaaagctaacgttcattataacgaccatattcgatataaattttttttataaaacatgtaaaggaaaaagcagaaatgattgagaaaagtaccatccatgaagtcttttgtggagattgatggtgtattctctcgtcaccacctcctccttcctccctttgcttcccttttccaccatttttttgccgccctctctcgctccaaaaaccctaaaatttcaagcttcagcggctgcagaagaaaaccctagatcgcggaactgaggatgatataaggatgctgtccttgtcgatattaccataatgcccttgatgtataatactattggactgggcctagtttatgatttatccgttagcccacaggctgtaaatgatccatttattgtttgctactcggaaaaatgagtgcgtattctcgcgtcctgattgggaaaaatgagaacacatttgtattgtcaatacacaacaactttatgggcttatatagaattaggatatatatacttaacattgaattcaacaaatatttgtataatataattaagggtttgttatagcaaaccaccacaaaaatatagttttttttttttttgcagaatcactgtaattttttttattttcatagagccactacaaaatattctggtttttcgaaaaaccacctcacaaattttatttttcattgaaccaccatgaaaaaaatgaatcttttacaaagtctcaccaagtcataatttacctacatattttgttaaattagtataaaaataacataaatgcccattatgacaaaaaattagagaggatgagtgggggtatttggagggcatgaaaactttttttggcaaggtaacaaaattttagaggaaaataaggtattttgttttttccccccccccccccccccccccccccgccccttttttttttcttttttttaataattgaatccaagatagttggggtcatgttgaaacctcccaactatctggatcaccagcgatacccgtacattttgttggtttgaaaaagtatactaacaaattgacatgtcacacgatgatggtattttagggatctagcattttagtttaacacgatatagatgcaaaactataatttgctagcactttgttatggatgcacatttttatggcagttctataaaaatttaaacaatttgtggtggttctctgcaaaaccattatattttgtgttggttctatgaaaataaaaaaaattatggtgatttttcaaaaagccactattttttgtggttgttttcttataaaaaaaagccctataattaatcacgagaaaattggcacatttgcattatagaaggtattattatgtaaagtttaaaatgttttgaaggttcgtaagtgccgccaaaaatgcaataagggaaacggtaaggtatcttagtgataatcatccaatagttagttttttaccttaaatcctgatttggcatgtctttttctcaaaaacttgagatatcaagattaaaatggtgttaagttctgagatatttttaggtggaaattacccttgatatttttaggtggaaattacccttgatctatagatgctctttgtatgaacccttgacgaaagcccaaaagtttgctccgcatgaacctcaccaaaaccaactactcacctcttaaaatcggtaacctcgccgaagcttggccacacctttacgcacagcgtacgaaatcagcaaacgaaggaaaaaaaaatgcaaaatagatctattttgctagatatttagcaaaaccgattgttttgctaaatatttagcaaaatagacctctttttggccaacaggtcaaaaagatatcgattttgctaaacaggccattcgaaacatacaggactaatagtcccgtatgatttaactagtcctgtatgtttcgaatgatctgtttagcaaaatcgatcttttttggcctgttagtcaaaaggaggtctgttttgctaaatatttagcaaaacagtctgttttgtaaatatttagcaaaatatgtctattttgcaaatttcttcgcaaatgaacccaaaactccacttctaaggccaacgttccggatcgaaacacgtcataggaacaggataagttactcgtccctgaagcctacccttgtgctcactcgccgctaatccttcgctgtcgtggcttttaaataggggttggaaacgtaaccaaaactccaatttttttctatctccacccaaattacgagccctaatttccacgattccgaggcgagttcagaacgctagggttagggtttcgactcgatttctttcaatcttcattaaatttggatcgaatcgatgattaattcgaattccgcttttttgatttctgcagggatcgtcgtaagcaaccttgtagattgggggagatctttgcgccagcgaagggcgtcgtctaatcggtgcgtcgtgttcgatttcgatcaaagctttcgattttgatctctagggttagggcttggttttgttcgattgatcaatttgtttgttcactcttcaattttgttgtgatttcgatgtaatttttactgcgtgtttgtatcaggtaagaaagcgcgtttgggccttaggttttaggatgaagatgagattttgggcatctaactgtaacttttttttgtccgttctactgaattttcaacttttttgctgcctgttgtttttattcttatatgtatatgtgtatgatgttttgaagttttttttgtcgattattttctatgcgttagttcaataatgttagattatgctttaggacgtgcggcttctgcattctgcgtaataaataggaatttattgtattggatattcagtgggcttacataaaaatcaaaacttttaagtcattaagcatataggcttttacctagtaaacattcactttgtcgtatttccaagtagtggactaaccagtaaccatcctttttaattattggtacaatcaaggtttatctattaatgagttagttccataattttagactatgctctgcgcattaaaacaaggcttatctattgttgtgttagtttgaagatattagattatcagggctagaatatatgtggcttctgattctaagaaatgggcttctgtggtattggatatccactaggtgtacgtgtatgtcgtagtttcagactgttactaaagcatactgccttttagagagtgggcgtcacttttgttgtataattccagtgatgtgatgttttaagtatccttcgttatttatcggttaattgatgccttagtttgctacatgttcttctatagactattgttgagatatgtatcttttggtgaaatttgacagcctcttgacaagattaggtattactttcagatagttagaatcatctatgtgtgttgccttttaggttgtgtaattagtctttattttgtctgccttcccttttaagacaattaatgcaatagcttgtggtgatagtttggtcgtcctgctctccattgtaagcaggatttgtttcttgagatggatagtaagtgtattggaataactgaggtgcttaagctccagcgtgtactctattttcccttttagcttatttgagctgttcgatcaagcttatgatttgagatctgatgaagcttatgattttgtgggttagcttttctccttgcagttctatttttgtctttgtttcaatcgagtaccaggattatgtttatgttcttttactgaaaatctgtgttggtacagttcacccacagactattgaagagcagcgaatcagttatttcaccataagcttctcctnnnnnnnnnntgtacttgctttttcaacacttcgtgtacatgttttacatgcttgtgtgtaagaaattagtttcgttttgataccctttccctcttatattaagttttctttatgtaatttgttgatggtttgatgcagaaaactgaaacaatggagcaccacaatgagactggatgccaagctccggagggtccaatcctctgcatcaacaactgcggcttcttgtgcagccaccatgaatatgtgctccaagtgccataaggatcttgtattgaagcaggaacatgctaagctggcggcatcatccatcgacagcattgtgaatggaagtgggagtaccagtggaaaagagccacttgtttcggccagtgttgatgtcgctgttgcttcagtggagccaaagatcatttcagcacagccatctgatgcttctgtctctagcgagagcagcgaaccaaaggcgaaggagggtccaaccaggtgcaatgcctgcaagaaaagggtaggcttgactggcttcaattgccggtgtggaaatgtattttgcgcgatgcatcgctattcggaaaagcataactgcccatttgattaccggacggctgctagagatgcaattgccaaggccaaccctgttgtcaaggctgagaagcttgacaagatctagagatgaaaaagagaagataccgaagtcatgattcaactctcccttttctatctatgccctttctttctctgttggctgcttgttttcattggtgtcctttatccacataaatggctggaggcatgacgatgatgccttagggcatctttgcagtctcgaagaactcgttatctggttgattggtagaaaaggtttgcatgttctgtctagtgtgtaaacttttttatttggtgatggtctgatggacggttatgtgtctatgaattggttatctttgtaatctgctatcatagttcatctcttacactttagcacctcgaatggtgtgaaaaagtgcattctatctctgttactgttgtgttttgaacttttgaggtttcttttagcaccaccaaagcatttagaaaacacatcacaagattccagctgtataatttctaagttaggagctgtttggatcagttttttgtatcggtaaaagagaagaaaactgccaaaaatgtcagctttttgacaccttttccccaaaatcgcctcttatagaggcgattttgggggaaagctgtcaaaaagctgacattttggcagctttccccctcctttccccttccaaaaaccggaaccaaacagcccctaatgtctttgcaagtagtaatcctctatcctcagggatacagagaatgattgcgctatatttattatcgcttaacatttcaaatggacccctggtcttggagctctgcatttgtgtatgttgtgttcattcaggtgccgatgcacatacatgcacctgtgaactgtctttatgtatactttagagcattttgttggaggagtgatgttttagcttttgacgtttattgttgacttggttaatgggtaagagtaacagaaatgcttacttaagcaatgtacattgggatttccctcagaaagggaacgcatgggatccttgtggtgaggtctatttattaattatgcttctatgattggtattttgggttgtttgacacgaattttaagtattttctttatgaatctcagtacattaaatccttttttatctttgtgaaattggtaatctaggctgtgaaattgataagatagcaatgccttttcaattatgcgcatttttttctaaagccaagttgctcatctgacttgggagtttgacaaatgttcattgaaacgtgtgtgtgtgtgtttttaggtgacttgggactaatatctaaagccaagttgctcatccttttttacagttgaatttcatttaggtgtcttttttcccctcaaaacttattaggttgttctgcattctattgcaaaattttggtatttggtttttagatattagtcccttaaatcttccgcacttcgaaatttgtccctcaaatcatggcttgctattaggtcccttaatctattttgaaattagtccctcaaatcattgaattttctattaagtttcaaaaatctcaagtcattttgaaattagtccctcaaatcaagagtaagaacagcaaatagagaccaattgctcgcttaaaatcactgaaatcgtgatcagattcccaaattctcgtaagtcattttaaattaatccctctggttcctacttttattcttcattggagggactgattcaaaaacagcttaagatttgggggcttaacagtaatttccatgattaatttgagggactatttttaaaataactttaagacacgagggatgtaacttccatgatttgatgagaacatgtttgaatgacgaagaataataaatataaaatgaaagaaaaagagagcactctctacttcttccagtggttttttgttgctaaaaaattgtagcgtagaacaaattaacacagtaaacaaaatggtttcatttattcatttcataaacgagggggaacaaaaaatacaccaacctccaaccaaccaatgtctcaaaccaaacaataagggaaatagtgaatcataaataaggacattaaacaaattacgccacaaatcattccctaattgcattgttaacccacaacttaattaactctcatctccttcgtactgatctcttgttactgcaagtagagagcaaggaaagagagagcagaggctccgatgagagccccgacggccgggccaacatcgaacgatgcgctggtgggggctgccatcgcagtggtcgctgaagctgcggcgacgaggacggcgcagaccatcttcttcatctccatatctctataggaattttcaggctgatgattataagggtttttggagaagagaatggagttttgcgttgtgaaagcttgaagagagagggaggaggagggagggtttttatagtgggaggagggtgggagctggagttgttaatagttttgaggtgattagtttattggattgttattgttaagattttttttagagggggtttggtggcctccatgtgtttggagatggggttttatatatgtgcttgcatgtgggaaagtgttctattggatttgggtttatgaggagtttacccgtaatcaaaccggatccatatgaaggatacctggattcgggttaagttggtagtggtgcaatacaaatgtcagcttatcatatccatatctattcactatcaccgatacacataggaatacaaatacagaaaacggttatccgaatcctactaaaataataaaatatgacgaaataggagacgttattatacacagacgcgaagccatgttatacaatgtaaatcgtatgaccaacaaattataggatatttgactacagatctggatattttattctaatatcttataagatgtagatactttgtatccatattcgtactcatatacccgcaaaatcctgtaagttggatgcgtgtccttatcggatctggattcatattattgaccatccgaacttaataagcgcaagttattggcctcggaatccatcatacataaattggtaatttgtaaaacaaataggaagaaggtgaacaggctgttgtgggcccaacgtatgctgttcctttgaggaagcccaccaacccaatagaaatgtagcaagtaaagaaaactggagcccacttaaggttgttaacagcccagaagcgaagttgacccgaatcatttgcaggtgtgctaatgttctggaattatgaaacattctttgagatgacagagtagaaaattgccttctggttggctgcatgtttttatacggcaaaagaaccagcaccgaaggatacggcacccacttttccacccacaagacctatataaaaatttataaggagttagattgagacttattactgaaatttcacaattcaaagttggtgagggcattaattccaatctcatttatactgatataaaattcgatcaatatcggtatttactatttgcaatggtctaaaattcatagcaagtgttaagatacataattcattttattcctttcctatatgtttgaaaaaaatcataggaagcatgaaagtaataaaataggatttttttattatattgatttagaatctattactagatagttttctcctccttgtatacgacttcctattgagcgccctctactagatttctgttagcttgactcagtcatggtgaccaaatcaacgattctcagtagagagaattgtggaacgtgaaaacgtggaagagttgttgagagaaaatctctcattggggcggatcttgggggggtggagttagtgggttcatcccctataaatggaggagtaattctccttgagaaatcacaacgaagaaggtgaaaaacctcttacccattagcggaacccctctcaatatctgttcttccttcttctctgagttcaaatactggtatcagagcacgtcgatctcatcgccgcccccttggagctctgcgtcaatcggccacctcgacgactctgctgcgacgatcgatcgacgacgacgacgacaactcgacgacccttgctgcttcgatcgacaacgacgatgatcgacgatgacaacaaatccgcgccgatctcaactcagtcgtctccatcctcggcgattaacagagacatcagccgccccttgcaattttacggcgtaaccctagctcccagctcgagatcattttttaacagcttcagtagggcacgagtggggcactcgttttctcaagagccgagttacaaagccaggcccaattaccacaaccagcaaagcccatccactttattcgtttaatcaaagccaaaccatttcattttttttgaatcaaagtcaggcccattcaacctcacgttttagaaactaaggccacttctctctataaaaaaatatcactttagtcctttacaattcaatattctgttttcaatcattttgggttgttcgaacaattcttcgcaatttctattcggtgtaactccacaacagcagcagattatctccaaatccagtcagaaacgacgccaaaacttcgataagagattcttcggtcaacaccgctaagcgacaatctcgctcaaattggagcctctttcatcaactcggaacaatcaggttcatttttatttaattaattaatttattttaactttattattatttagtattattgtcaaaatatcaaccttatacaaatatttaaaattgaatttagttttagttctttaccgaatggctagtaaactcgttctatcagaactaggcaaaattgacaaatttaatggcagtaattatgatatatggcatagaaaaataggatatgctcttattcatgacaacattgatgatataatcaaaaccactgctccaatccttactgataaatctacacctgaagaaaagaaagggtttgaacagtggaagtcgaaagataaaaaggcgaaaagtcttatgctcatgttcatggaagataacttaatcaaagtttttgaaacttataagacttccatggacatgtggaatgcaataaaaaaaatacgacactgcttctgaagttaacattcaactcctcttgcataagtataattcttgtcgtatgcaagagggagacaatgtcgtagagtatataaataaaatgattgtcatggctaaggacttatccactgctgggaccgaaatcctgaaaagaatgcaagtggcaaccattttgaatagtcttcccccttcacttgttgtgcctgccaccacattaagaatgaatcctgccattaagtctgtcactgatcttcctatgcacctagcgatagaacagaacttaatagccagtaggaaggaaccagaactgaatatggtatagcaggagctgagttatgtccgccagatgcataataccggaagctataaaaaccctggttctagtaaaccacaaccacgaggatcgaaatagcagtagttcaagagaaaaaaagtaccccgcagagcctgttacaattgtggaaagttcgggcatttcaaacccaattgcccacaaggtgaaaagcaggagaataagggaggctataagcatccagaacaaggggggactagcaaaagagaattcgtcggagtggttggtggatcgaccccggtgcgactaggcatatcgcaaaggacaagaatggagtcgtagaattcaccgagctgaagaaaggagaacatagaatctatatgggaaataatacctatctcgatgtagaaggtattggttcgtatagattggatcttggggacaacattcttgtcctcaaagatgtgttctatacgccaggaattcgacgcaatctgatctctgtttcagcttgatgaagaaaggactggaagtgaggttctataataacagggtttctataggcaagaataataaagtgtatgctatgggtaaatatgtgcccgagcatgaattatgcattcttccagtagtttgtaataattctgataataaaatttcgaatttgaactacttgtcttattatatttctaaatctgaattgtggcattctagactaggacatgctagtatttcaaaaataaaagaaattatcaaaatgaacttgcttcctgtactatctaatgttcaattgccaccatgtgaacattgtttaactggtaaaatgactagaaaaccttttgttggcggacatagagccaatgaacttttagggttgatacactcggatatttgtggtcccttaagtgtcaaaactcatagtaataaagaatattttattacttttatagatgattattccaagtttgcacacgtctatcttatatccagaaaattagaagcttttgactgttttaagagatataagacagaagttgaaaaccaacttggattgaaaatcaaaattttgagaactgatagaggtgagaaatataactctaaagaatttgagagttattgtattcagcatggaattaaaaggcatacaacaatgccatatacgccacaacagaatggtgttgctgaaagaaaaaacagaacattacttaatgtagttagatgcatgttgtctcattctggtctctctaaaaacttttggggagaagcattgttaactgcaaactacattttaaatagaattcccatcaaagtagtagtatctgcaccttatgaattatggaatgggaagaaacctaatttgagtcatctcaggaagtagggatctatagcccatgttcccattccatgtcaacttagagataagttggattttaaaataataaagtgtagattcataggatattcagaaaagtcaaaaggttataagttctataataaagaaaaaggagtcattgaaagcagagatgctacatttctagagaatctagaggaagaggaacaagttcgagaggaaacataacctctaactgtaatagatgatgattattacagtgttgttcctactaatgactctgatattgtgaatgaacctaaccttgaaaataatgaaatacctatggaaaataatgtacctaatcaaccggttgtaggcaacaaaagggcaagaacacaaccttcatggatggatgattactatttgtattcatgtgggccatcctatttctcggtagatacaaatgtagaagaacaatatctcttaaccttttctgatgcgatgaaatcgcatgaatcaactttatggctagaatctatgagagaagaacttgattctatagaaaagaataaggtatgggagttatgtgatctactagaaaatagaaaagccataggatgcaaatgggtgctcaaaaagaaatatcgtattgatggatctattgataaattcaaagcacggttagttgccaaaggttataaccagaaggcaggaatagattttcaggagacgtattctcctgtagctaaatttgcatctattagaattattttggctattgttgcatattttgatttggagttattccaaatggatgttaaaactgtattccttaacggagagttgaaggaagcaatatacatgcaacaacctgaaggttttcaggtgaaagaataggaacataaagtttacaaattaatgaaatctctatatggtttaaaatagtcttctagacaatggtatctcaaatttcatgatgcagttactaaacttggttttattcaaaataaattagataattgtgtatatgtcttgaaaagtgggagcaagtttactatattgtcattatatgtggatgatatattgctcgttggaaatgatatagaaatgttgaataaaatcaagacagatctcagcgaaaagtttgagatgaaagacatgggagatgcatcatatattcttggaattcaaataattcgagatagaaagcctagaatgctaagtttaaaccaagaaaaatatttaagatcagttcttaaaaggtttggaatggagaattccaatccggcaccaactccgttggttatgggaaagagattatgtaaagagcaaagccctggagaggggtagaagcctttagatgttccttatgctcaagcaattggaagcttgatgtatgcaatgttgtacaccagacctgatatagcttatgctgtgagtctagtcagtcgatatcaaagtaatccaggaccagcacattgagaagctgttaaaaggattatgaagtatattagaagtacattgactcatagattagtttatcaagctgaatcgcttgaactcctcggttattctgatgctgatttcggaggtgataaagatgatggaaagtccacttcgggacacttattcatctttggaggaggagctgtttcttggagtagtaagaaacaagggtgtgttgctagatatacgcaagaagctgaatatatagcttgcagtatggcaactacacatgctgtctggacaagatgatttttgattgatcttgatctcaatttgttagaaggacctattgatatttattgtgataatcaaacaacaattagcttaatcaatagtggcgcgaatagctccaaaggaaaacatattgagatccagtatcactatattcgagatattgtagaaaagggagaagtcaaagtgacttatatccctactatagatatgattgctgatcctttgacaaaaggaataccaacggaatcttttatcaaacatgtaagtttgatgggacttaggaataaataagtccaagtaaaatttcatgaataatgaaataagagttactctctacggatagtgggagtaatgataagcagaaacatctgatcttacggatagtgggaggcatgtcacttggttaatttggtcaagtgggagatgttagcttgactcggtcatggtgaccaaatcaacgattctcagtagagagaattgtggaacgtgaaaacgtggaatggttgttgagagaaaatctctcattggggcggatcttggggggtgaagttagtgggttcagcccctataaatggaggagtaattctccttgagaaatcacaacgaagaaggtgaaaaacctcttacccattagcggaacccccgtcaatacctgttcttccttcttctctgagatcaaatgaattagtagagggcatttattccaatctcatttatactgatataaaattcgatcaatatcggtatttactatttgcaatggtctaaaattcatagcaagtgtaagatacataattcattttattcctttcctatatgtttgaaaaaaaagcataggaagcatgaaagtaataaaataggatttttttattatattgatttagaatctattactagatagttttctcctccttcctcctcgtatacaacttcctattgagcgccctctactagatttcttccagcattcatggtgggcttatacttcataatgggttgtttggtttgaaaggattttttttgggggaaaagaagtcttccacggctttaggttaaaaatagatttgaaatgagttaaaaatagatttgatcataatacggtgataattcatctcatctcatcttttttcttagttttaagaaacgaaccaaataaaagaaaaaaaaaacttattatagaaaatatgtttcttataattaatttcattatttttttagccaaccatacaaaaaatttaaggaaataggcatcggaaacctcgcgccacatcatgaaaacgagaaatgtcatttctgagattggacagaaaacatgggaaacaataataaaaaattgctctactcatttattatcaatcattgatgtcttttttatgatttggttttgccaaccaaaacattagattgcatagaaatggttttccatccttcatttatcgtgaaataagcattaaaaaaaatgcaatttccataaaataactagaaaaatatggaaataaattttttgcatgaaaacctatttcctaccaaaaaggttttcatgcaaaaaaatgctaaatgtacggcgatggttgtactattcttgtactactaggtacaaagaagtatggtccgtagtaactcattatttttctttacaatttatataggaaatgatctcaatctttatgggtggtagtacaagaacaatataattcttgtattagtaaagtttttgctactcattttcctataatctagagaaacccaccaaaacaggcccttagaaagtcttttgagcctttgagggcctttgaggataatatataacctattggatccggatcaatgacaaacctaaccggacccgattacggcgtacggcaaacgcgagccggttagcgctcacaaaaatcgccaagaaaagaacctctcttaacccctcagcaaactaaataattccagacttgacccatttcctcactccaacccccgttcgaataagctttccctccctcgtaaacaaatcaaaaaattacaaaaacccccctcgattccccattcccgcctcaatcccttccatcgcctcttcaaaccctacaatttctctcccctccccctcttcatatcattgatcgagacccagggttcgcagaatggatcctcagatcctcgtcgccctcggcctctcccttgtcggcgggctcagcacctcaattggttcgattctgggttttgatgtcattttcttaaaatttgtagcttttttttaaaaacccgttctcaatacgtttttgcccccccttttggttcttaaaaagttaaaaactgatgttttttatagagaaagtttttttttttacttgttacagctagttgatttgtgatgtagagcagcttatggaaattataatgtagttagcttagaatgttgatatagatttgtggtaagcttcgttttgagggagatttgcttattaacggaatgataggagaagattacgcaaatttaaacagggtatcattatgaatatgcatgacctcaattgtgtagtgtagggtagattaaaatcaaaaggaaaaaagatacatttttaatagatttatgagtgtgcatgacctcaattgatgcttttgctgaattaagtgatagcttcatcagcggccattaagggctctataaaattctttgtaatataaaacattctttacttctccttgatggaaattgtttctcggtggagaccggatatgttggggaaattacccactaaaccagagaatagaacaatcacaaacacaatatttacgtggttcgatcaaattgatctacgtccacggcaagagggtgtatcactatattcaatctcaacatacaacactcatacaaaatattgagagctcacagatttcttgtgtggctttctctctctttttctctcaatcactctctgctggtttggagttttggagtgcgttttacagaggaagagaggggggttttatagcttccatgccttctcttttgtcaacaaattcggcacctcctctctcttgatgtcaacaacggaggctgcacctccccctctctcttgatgtcaacaattgaggccaccgaaagttttgttggcctcaattgttgactaacaatgactaacaatctccacctcggtgaagttttcccaaaaaactgagccgacaccaataactagtgagtcttcacccatcttgcaaacaatgccccaaaaggggccacttaacaagtgcgaatgcctcccaaattcaagcagtgcttgaacttgaaggccgggatcggtttggtcaacatgtcagctgggttgtctgcagtacctatctttttcatcgtgatgtttctttcagcagttgcctcacgaatgaaatgatatctgacatcaatatgctttgtcctctcatgatgtgctgagtttttgcttagatgtattgcgctctgattgtcgcaaaatacaactgaactagcctcctgctgtagtccaagctcactcacgagatttctcaaccaaatggcttcttttaccgcttctgctgctgccatgtattctacctctgtggtagacaaagtaactgtcgactgtagagtcgatctccaactaatagctgagccagaaagagtaaaaagataaccagtcaaagatctccttttatcgagatcacctgcatagtcagaatccacaaaacctacaactgaggttcccaaagtactgctatcaaaaactaaacccaaatctgaggtacccctgagataccgaaggatccactttactgcttcccagtgtgccttccctggttgagccatgtatctgctcactacactgactgcctgggcaatgtctggacgagtgcaaatcatagcatacattatgctacccactgcattggagtatggaactcgggacatctccttcttctcgttctcacttgtaggtgaatctgaagccgagagcctaaagtgaggagccaaaggagtcgtaacgggcttggccttcttcatcccaaagcgttcaagcaccttttcaatataactcttctgtgagagatataaagttccagctttcctgtccctcctgatctccatacctaagatcttctttgctgcaccaagatctttcatctcaaactcatcactgagttgtttcttcaaaataagaatctgcgacatgttcttagcagcaataagcatgtcatcgacatataatagaagataaataaaagaatcatctcctagatgcatgtagtacacacaactatcataagtacttcttgagtacccatgactaagcataaaattatcaaacctcttgtaccactgtctgggagattgcttcaggccgtacaaagatttcttcaatctgcaaacttgatcttctttaccttctacgaagtatccctctggctgagacatgtagatagtctcctcaagttcgccatgtaaaaatgcagtcttcacatcaagctgctcaagctccagatcaaatagagcaaccatggcaagcaatacacggatggaggtatgctttacaaccggagagaacacttcatcatagtcaattccctccttttgtctataacccttagccaccaaccgtgctttgaatctagcatcttcaacccctgggatcccttctttcttcttgaaaatccacttgcatccaattgcccttttacccttaggtaattgcaccaaatcccaagtctgattcttgtagagtgactcgagttcttctgtcatagctgtggcccaacgtccagattctccgcatgagacagcttcagtaaagtttgatggctcttgaatactcatctcttcagctgtcgtgagagcatacgccactaattcagcatgtgcatatctttgaggaggtttgatctgtctcctctctctgccagtggctatggaataaggttcttcagtctcagcatcatcagcatctgagcctgaatcatgttgctcttctacagctgtaggagcaaattttatagacgacttttgagacgtctctccctcgagctccacctgaagctccaccttatccatggtcttctctacatttcctgtagactcaacagaaaccttcccatgatcaagcatatatctttcattaaaagtaacatctctactaataatgaatttaggagaatcaggttcaagactccacaaacgatagcctttaatgccatcagcataaccaataaatatgtatttcttagctctaggctcaagcttaccctctctaacatgatagtaagcagggcatccaaatacctttaaatttgaatagtcatttggtttacctgaccatacctcatttggagtcttgtgttcaatggctgtagaaggagaccgattcaccaagtaacaagctgtgttaacagcttcagcccagaagcctttatccaagccagagtttgagagcatacacctagctctctccatcaacgttctattcatgcgttctgccaccccgttttgctgaggagtgtgcctgaccgtgcgatgtcgtacgatcccagaatttgagcagaactgattgaactcaccactgcagaactctaagccattatctgttcggagacgtttaatcttctttccagtttgattctcaacaagtactttccacttcttgaaagtttcgaacacctcgcttttgcgcctgagaaagtaaacccaaactttcctggaaaaatcatcaataaacgttagaaaataaagagcaccacctttggatggaacctgagcaggtccccataaatctgaatggatgtagtcgagagtgcccttcgtcgtatgtgagccagtcgagaagctgacccgagtttgcttcccaaacacacaatgctcacagaaatccagtgatgatgtatgatcaccacagagtaagccacgtttactcaaaatagtcattcccttctcactcatgtggcctaagcgcatgtgccacaactgagtagtgtccctatcagcatcagaagacatacctgcagagcctgtcaccgtactgccttggagaacataaagactgttcaccttactacctttcatcacaaccaatgaacccttagtaactctaagagctccgccttcgccagtgtaagaacacccaatagaatccaaagaactcaaagaaatcaaatttttctttaagtctgggatgtgtctcacatctgataaagttctcactatcccatcgtgacaccggatgcgaactgtaccaatgccaactgtcttgcaaactgtattgttgcccatcaaaactgatccaccacttatagatctgtaagtagtgaaccaatctttatttggacacatatgaaaagacgcacctgtatccaagatccattctttatcggaacggccatccaagggacatactgtaagaaccgtctcaacaacaacgacaatattagcctttgccgtattagctgaatctgaggtttcaccacgctggttgtctttcttctttagagcataacattctgacttgtaatgccctttcttgtgacagtagaaacactccacatttttcttgtttggggctgacctggactttgagcgatttctggattgccctttatcaccctctctggccttcgatctacctctggctagcagaccatcagcctgcccatcggtacctctcccattcaactttgttctcaactcagcagagttcaaagaggccttcacatcctcaagacttatggattctcttccatacaacatagagttaacaaagttttcataagagttaggcaatgaacataacacaatgagagcctggtcttcatcatcaagtttaagatccaggtttttcatatccatgacaattttattaaattcatcaaggtgttcctgaatgggtgtaccttccttcatcttcagtgtgtatagccgctgcttcaggtataatctcgtagtaagagatttcttcaagtagagactttcgagctttgaccacaaccccgctgccgtttcctcatcggcaacttcacgaagcacattgtcggatagtgacaattgcaaggcgctgtgagccttttcgtccatctcttcgatctcggcactagtcatatcttctgggtatttcccatcgatagctttaaccgtgccttcacgtcgcaacaaagccttcatctttatcctccataggccgaaattattttggccatcaaagatcgacaccgagaacttcacagaagccattgtggaggattgaaagctgtcctagaaccgagaagctctgataccagtttgttggggaaattacccactaaaccagagaatagaacaatcacaaacacaatatttacgtggttcgatcaaattgatctacgtccacggcaagagggtgtatcactatattcaatctcaacatacaacactcatacaaaatattgagagctcacagatttcttgtgtggctttctctctctttttctctcaatcactctctgctggtttggagttttggagtgcgttttacagaggaagagaggggggttttatagcttccatgccttctcttttgtcaacaaattcggcacctcctctctcttgatgtcaacaacggaggctgcacctccccctctctcttgatgtcaacaattgaggctgcacctccccctctctcttgatgtcaacaattgaggccaccgaaagttttgttggcctcaattgttgactaacaatgactaacaggatagaaactaatgatagttttgtgcttggttcaggtgcactttttgtggttcttactcatactcccaatctcaaattacttggtcttctacaggtgttttttttatttatttttgattcccttttcctgttgcacttaaggaagatttcagtttagattggtttttttctgatcagggttttgctgctggcctcatgctgagcatgtcatttttggacttgacccataatgctctgaactccgttggctttctaaagggtaacctttgggtgagacttattattattgttattattattattaaattgctggcaatctagcagggtctgatattggaatttagaagtcatcaccttcatcttaacgcatattcattctataaccggttaactttatctaaaaaaattattttatcatgcagttttgtgcgggagttatttcttttgcaattgttgttacttttatacctgaaccttcacttgttccaagaacagatgtaggtaacaaaaaggtatggaccttcgaatgcagtttaccttgattcagaaatattgtacttctgcgtgtagattctagtcatgttcctagtatggatgggcattcaggatattcatttacttgtttgctttcgtggtaacaggatgatgatgatgatggatcaggtaaagccattatgaagaagcatcgccggcaggtcttatttagtggaattatcactgcagttggtaagcatgctctgctgtttagaatgtatctttccgttctctgtattctaaattcatcgacacctagagtagcaaaattcattttggagaattagtctttagggttatttttctctttctcaagctcctagtttcatctttagtcctgtacatgacaatattcccaccagaattagcgtgattctatgtgatatatttgcattattagggaccaaaggcatgatctatctctagacatgtattgatgattatctgcaccttcatcattctacgtcatttatgatcgcagatcaagaatgttgatatggataactgaatttagattataatctgaatgatgcaactaaaagagtttgattgatacctttgtatagtttttacattttcttagttcaggattatgattactctagtaacttcttctttatattttttagtgtataaattaggacttgatgaatgacttggttatgcaaattcggaaagctgagctattttactcatctgcttagcctgccatatcacagactacatttgtctgtcagataactaatgaccaccttcttggttttatctaatgaattattttcctttctataagttgcaggtattagtttgcacaacttccctaagggagtggcagtgttccttggttcaatgaaggtgtggtttttaatttttcttttgcaaaatatggtgtagcaagattcacagaataaagttccagatacacctgtttgctttcatacatagagctgttgaatagaccttcttgagacatagttcttttctattttgaatacgattggatcttattgttcttgaatcgctgtaccttcaattggatcttattgttcttgaatcgctgttgactagaccttcgtggtctctgagtctctattctttgaccatcagtccatgaattaccacacaatctaccttaccttgtacttattctgcctgctttaactggttaccgtaatataacaagacttgattggaattatcagaaacggtttatatgaaaaaaaaatcacgaaagtatgctagagacaacatttaaaattgacttgttatgcaataagggtacatgaataacaagcaaacaagatcatggtgcacaaataggtggcgtgtgccacacatgggtaggcatgcagattgactctgcattgtttggagttgaagtattgcattggtatgcatgagttagatttgcattcagcggttgtacatacttggtttgatgaatgaaaaattattatcatgaatgatgtaataatattgtcctagatgtgataaattgtaaacttggaattgttcatggaccattattaacgtagaattgtagaccattattaacgtattacgcaatatgatagcattttaaaaatggcttccatttaggaagcataaagtgtgctgcagtactggttggttattgtatatattctgcacaaagtagtaaacaaagtgctcttgattccaatggttatacttttttttttaaattttttacaggaacagggtaagatatgttatctgtagaaattcctgtcatgggtccatcttataattgtatgtgtactttatttattaaaatttcatttctgatgctgcgtgtcctaaattaggggcttcgtgttggcattaaccttgctctagctattgcattgcacaatattccagaggtatgttttcaatctgaaacgttcccatatatgcaaacataatctgccaacatctgtttccccctttattatttatttggaagctcatttggcgttcagctatcattaacacactttttgctcttttattgaactaataattcttttactcttgtgttatttatttggaatccttctcgtttaaaagccacctgtcgttaacagttttactcttttattaagttagtaaattataattttcaaacaaaaagtttcaagcttgtatttgtggtgtttctatacttattactcctgattaggcgcttattttcatctgtagttctcattataatgatctttctgtagggagttgctatagcccttcctgtccattttgccactcaaaggtaaggtttctaactccgcatgcatttttggcagtagacttgaatacattttggtgtcagcttagacgagaatgagatattgatggtaccattttttgaacaatttgtgttggcgaagtcccatctttttatttcactgtctactaaatgtttttcgctcctcccttatgttgtttttcatgagcatttagatccgagttaaaataactgcagcagtaactatctttctgaaagttatctaatacatttcctttatcgtaacatttttttggcgcagcaaatggcaggcatttaaactggcaagtctttctggttttgccgagccgctaggtgtaattattgtaggtatgtgatcgcttacttttatttatatgctaattttgacttacattgactctcgttgcgacttatttcttgtttctttctgatatatcatgtactgaaccgattttttctttcccaaaatcttggcaatagttcgcatagtgtcaccttacaatgaaaataattacagagcttgctgacctattccattgtgggacacctgcagtttatcgtgtagttgtactgtactgggtttattgagtgaaaattacagaacacttatcatcctatagacatgtataagcttatttaaggactgaaaagatagttttgaagaaagtcagatagtttcattctcaacaggttacttacattaagtttcatatctggtatgctatcattcagattatcgaatatcctatatatatggatttttcctgtaaattcctatgcatttcattagaaataaaacaacatctaggtatcacataattggtttaaaagatagcatggttttatttctttgaataattgcaaaaagacttgtctattctaaatgcagcttatctcttcccaaccggtctaagtcctgaaattcttgaaggcttacttggagcaggtttttcctcctattaagctgatcttgttttatgctcaagtgacaattttttttgagctgcattttaactgactgatttgtcttttgtacagtcggtggagttatggcttttctcgctttacatgaaatgcttccggtggcaattgactatgctggccaaaagcaagctgtgaaagcggtctttgttgggatggctttcatgtctgcaaggtcggttcccaacaagtagaataatttaccttttcgtcgtcattctcatttaacatcaaattctaaaggaagcatttgtttcatctcataacaaaatgcttttttgctaatgttgctttgaatcaatttcgcgttttgtaattccccaatgaattgggttggggttgcatcggttgaggaatgatttgtatattgatagtaacaaagaatgaaactcatggacaagggaagatctacgtttacagttgtgacactaatccttctcttgggtttggttttgatctgtgtttttttcattgtcttggcagcctatactttgtagaaatcagcttgccaaaggaaatgagtgtgtaaacgtgcgatggtctatcaattactgttgcagaaacacattctttgtacattccagaaactaggcaggtccttctcttgtcaatatatacaaactgtaatctgtatattcgttcaaaggaataaaattgttggcattacatttcttgtacatctttttccataacatttggatatcctcttacttgaaattgaaactgatctttgtcgatcagccgacccttttgacaaaaacaaaagagcaccgaaagagcttacagttgttgacaaaggaaaataaaacaaaaatggcaggcctcacagcatagtaaaatattaatattttattatgcatagtatttttccaaacactataaatagactccaaatccttaagaaaaaactcatcccagaaacaacttctcttgtagaagagtgggagaaaagagagagagagagtatctcctgttgtgcgcagcggaaatttcggcagagtttctggtacacaataagatagaaagatcgatgagaattcatgtctcaccaaggaaacaagaatctgaagtgaatatctcaacaaagtgggatatcagctcttcctctcatcagttctaggactgacttgtcgagggaacctaataaactattacaatggtcacaaacagcaaatcacacaagttttacgtggttcggcaaatggaaatggaatacaaataggtttacaaccactaaagatctcataaataaaccctcaatctaatctctcaattcctctctcaaaatcagcactagagactgcacaaaactcttacaaaagccgcctcttttcttctctgccgaaaagaaactcaaagccgaaaaccaaattctcctttcactccgcccgaagccaaagaagccgtctgcagttttatttctcctcttgcacatgaaaccctagaaagaacacgctatatatagcatcaaatgacattcgggtgggcctgtcaaaatctcactgctgttcacgtgctcctcaacgtgatcttatgacgagttgagaaaacgcgtcattcacacaaaattcgtggcccccacgagtcatgtcacgtcttcgttcgttcacagccccatgtcgtctcgtccttatcatttcacgcgttcataattctccacctcggtgaagttttcccaaaactgagccgacaccaactaaaccaaaatgtctcacttgttacgtccagtatgaagtgaaacaattcacaacaacagactcaatctacaacaagtcgagaacccaaacgagaatgcgaacaaactccaaatctcggtatcaactcagcaaaccggctgtatcataaatgactgcctacgtatcctcttgcccaaggaatcaagccttcacgtagttcatccaatggcctccaaagggctacgtatcctcttgcccaaggaatcaagccttcacgtagttcatccaatggcctccaaaggccctcaaacaaatagaaaagtctgcaacttaatcaagccttcacgtagttcatccaatggcctccaaaggccctcaaacaaatagaaaagtctgcaacttttccccaatatcaccaacggatctgcaactgatagcgctcccaatggccccaaactgaaatgaatcaaacacctccatctgaggtgaaccaatgaccgtatctaaatcatgtccaccggctgcaaccgaatccaaaaacaatccatcatctgcatccaaatccaaaagatccccaaactgtgtcacttcagctagaatcccaaatgatgcagtatgatctagagtatgtggagtaatctccacctaatgtgaagtagcatcactcttcacccgctgcgatacatctaaggtctgtccaaaactctccacctactgagagtcaaatagctcccttgtcgaagcctcaaccgaagtgacactaccagaccaaacacccaattgagttttacctcctatcacagcagttgacaactctttaataagatggtacaaatatgtcgaagcctcagtccagaaactcttctgcagaccattgcttgacaacaaacattgatcctcctccagcaaggcacggttctccaaatttgccaccctatctagttgccccaagattttctttccaacgaagtgtctcgaaatgccgtgagctcgggtccaatacagaaataggtccatcttgtacctcctatcaaaatcaaaatgaagtacctccacttttctgtctatcacacacttcttcaatttgttagagattattgggactttctccaatggggatttggttgcaacccaaacacgcctagagcattcaccaacaaaggaaaccaaacgcctattacctcccaatgatgcccccttgaaaggcccccaaacatccacatgaactcctctagaatgacccttaacacggtgaatagaggtgccaaacttcacctcggtcttcttgcccacatcaacatgttcactggacttcaagctgcaggtcttcgcaccctctttcaatctatgcaaggaatcaatactagaatgaccaagccccaaataccatagtctagtcaaatcaacagaagtcgccagctctccacctgtcactatacctccagtcaagtaatacatgttattcctcctgacgcccttcatcacaatctgagagtcttccacgatctcgagaaccatgtcctcaacacgaaccttcagactctctccaaccaaagctccaatcgagatcaagttcttcctcaaggaaggaacatatctcacatcatataactccctaacagtcccgtcaaacatcttgatacgaattcttcctatcccaaggatctgacatgcacggttatcaaccatgtacaccacaccactatccagcttttcaaaactagagaaccatttccttctagggcacacatgataggtcgcatcactatccaacatccattcagattcctctgaatagctatctgtaggactgatagaaagtgaataaatagaaaagtcagaaatattaccatccgatataacaatatttgcttctgataatggttgctttccttttcccttctgcttattcttcatccattcgtcgagctttggatagtctttcttccaatgatcagtctccttgcaccaagcacactgatcttttctaattgtaggatgtcctactctagactgtaacttttaattcttccggtttggattcttccctcttacgatcaatgcttctgttaccggctcaactgaagcctccttatccttctttcgaagctgataatttataagtgcagcggtgaccttactatacgaaagagatcccttcccattaataagagtaaagacgaaggtcttaaattcctcgtcaggcaaggaactcaacagcaacaacgccttgtccttatcttcaatcataacatccacattcgccaaatccgcaagaagcttcgtgtagtgattcatgtgatctctaattgaggttcccttcttcaactggaaacgataaagtctcctcttcaaatgcaagcaattctcaatactctttgtcagatacttgctttcgagaatctcccaaatcttcctcgcagaaatatcattcatgtaggctgtctaaaaatcataatagatagcttatccctcatcaaacaccgatgatggaagttacaatctgacgacttccagaaggctacaatttgaagactttcacgtagatcgctgaaggttacaatctgacgaccttcacgacaaccgatgagagctctagttcaacagcattcacaatcaacatcgggagttacaatctgacgactctcatattctcaaggagccaagacgaagattacaagacaatgatctttacaacgctatgacaaaagagactgctttgtgataatctcttcaagacaagacgcggaggtcctccccgtgtgtcaacatcaaaatgccggggtcgaacacgcgttacaacatcaaaacgcgagggtcgaacccacgttacaacatcaaaacgccagggtcaaacccgcgttacaacatcaaaacgctggagtcggacccgcgttacaacaagcgaaacgtgagcgaccctcgcgttctggatgttcagtcaacacccaacctcgcgtctcaatcctaagacgcgaggttaggatcctgaacgccaacgtgggcgtttgactcattcaaatatgagtcgaacggtttcagaaccattttccccacgatctgaggaaatcacgcccacttaggagcggagttagagggcagttacacccccttaatcccctataaaagcgagtaaactcaactgagttaaaggtgggatttttcttggcttgaatcgaccattgagggctggctttttggaacggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacatacaaaagatggcgactccgctggggactagcttttctgacgaagaagtggtggcgcagtccgacgtccacctcatgggaacaactgttaaaactctcgtcgtagagtttgaccaagcaaaatacgaggaagtcctctcctccggatcgcttagccccaaggccaagcgtggtgtccgcaagatctccaaggaggtcaaatctgttgttgaaacgtcaaagaaagttctctcctttggccaaaattcgtcgaacagcccctccgctccaggagcgggctcggcctctgctgaactcacacagcgagttgaatatcccacctccgcgtcagcacgacgtgctacaggccataaacggcctatagaggagaccagctccataaacgtcaacgacgttgctgcaaaagccttgaaacaggccaagaagaacgctgctcgtcgaagaagaaggtctcaccgacgagcacaacttcaaaaaaatcgatcctccaaccaacgcgagattcgcgttcgcgagcctgaacgcgaccctgagcgagcccaaacatgagcttcgcgagaaccagactgaacatggccctcaatggcgcgttttacagccaaaatgcgaacctcgagccttcgttgaacgtgaactttaacttcgcgtttccaagtcaaaacacgaccttcgtgtcgacgctaaagaacgcgaccctcatgtcgccaaaccaaaatgcgaccctcgcgtttcaggtgccaaacgcgaccttcgcgtttcaagtgccaaacgcgaccctcgcgtcccaagttccaaatccaataccgcgaatactctgcgtagcgcgactagattgaggggcagatataagaagtttatggattcaaggcatctcaaccagtcatggattcaagtcatctcaaccagatccatgtttaccaagagccagtcctgtccaatcatggactgggggttccaattcaaacctcacaatcagtgagtaattctcctcaaatctttacaacagatttgagagagttcacatcgagagtaagaccgatgcaacaagtcattcgttcattccaacgtgaacgactgattcctacggtcctctcgggatgtcaatgttgttcatatttgagagagttcatatcgagagaaagaccgatgcagcaagtcattcgttcattccaatgtgaacggctgattcctatggtcctctcgggatatcaatgctgctcatatgcggccaaaccattggtgttcgaccaattaacggacgttgctttgtctaaccaacgacgacattcgcacaggaagaagtctccagagaccgaatatcctgaggtcactatcaatgtgatcggcagagggaaagcctcaggtcctagttccgatgactctgagacaagtcgttcaccgaccgtcagagaaattgctaacgagtttgaaggagtttaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaggaaaagcgtcttcatcccgacttcacacaagaaaagggaaggaaaaagtggttgataacgctgcttctgaccaagaagcccataacctggaatcttcctctgatgaaggaagagagactgagaacgagtataatctccagtctgccaaaatggaagaattggaagaccgcctcaatgccatggccaacaaaagcgagctccaagacgagggagttgtcagaccctatcctgccgaatgggatgcagccccttatcctctaaaatttgaagtcccgacgctacaagcttttgacggcacgggatcaccgaaccaacatatctatcatttcaagtcacagactgggaatgtgatatcaaacgacgccatactagctcgattgttcattggcaccctcaagggagttgcctttgaatggttcaggaaactgcctgcaggatgtatccaaaagtgagcagatttagagagactcttcctgtcaagattttttgaagaggatacagaagtctccatccatatccttctcgccactaagcagaagaagagggagtccgtcaaagccttcgtcaagaggttccgaaccatggctctccggtgttcgtcaggtatgacacagtctaccttagtagagacctgtcgatacaacctgcagaccaacatcctagctcgaataggggttgcagaatgccgttcctggagataactgatctctcaagacgaacaggctcaaaagattattgccaggatcatagctgaagaacaaagtaggcaagatcaacctgagcaatcggaccaagcccaaccttctcctgagcaatcggaccaagcccaatctcctcagtcagaaggggaagatactacgaccactgaagctaatcctcttcagtaggatgccgggtctccaataactatcacgttaacaattacctctgatagtcaaactcgctagataatgactcactaggcgatgtgtcatgtcttctcttttccccctgcacttgttcaagactgggggttggtttattggtagtttattggattatgagtaataaattttctgagttgttatgtttaatagaatacatttgtcaaccaaaaaatctaccagaactatcacgaccatcaacttgtcaatccgcttcaataggatgacaggtccactaaaactatcacgttaatgatcacctctgatagtctgttttctccaaatttccccaccaatcctcttcaagtaggatgacgggtctatcaaaactatcatgttaatggttacctctgatagtccattccctccaaattctcttgtcaatcctcttcaagtaggatggcgggttcacaaaaaactatcacgttaacagttacctctgatagtcaaactcatcagataatggcctaccaggtgatgtgcctctattctgacttcatggatagtgcctcactaagcgatgtgccttgtctacctcttttttattcccctgctaagtcttaatcaagactgggggttggttacttgggatccattggattaagagtaacgaatctttcacattgtcgagttaacattacacttctgacgatcatcatccccacagagtatgcattcaacttgcatcactcctaatttgtcacgttaacaatatacctctgacaacaatcaacttatcaatccttgacaataagattataagttctcaaaattgctcaaatcgcaatcttccccagcaagacgctaagtcttcaaaatcttgttcaaatcacaagcatcaaaatttatcgcttttgatgataaactcatttagcaagtttccccagcgagacgctaattcctaaaatcttgtgcaagtcacaagaacacattcctgtcacgttaacaatatacatctgacaacaatccacttatcaatcctcgtcaataggatgataagtctccaaagttgctccaattgcaacacaaactctcgtcacgttaacactaaacctctgacaacccacttatcaatcctcttcaataggatgataagtccacaaagttgctccaatcgcaacatcctcctgtcacgttaacactaaacctctgacaaattcacttatcaatcctctccaataggatggataagtccacaaagttgctccaatcgcaacattaaacctctgacaaatcaacttgtcaatcctcttcaataggatgatgagtccacaaagttgctccaatcgcaacacaaatcatgtcatgttaacattaaacctctgataatctacttatcaatcctcgtcaataggatgataagtccacaaagttactccaatcgcaatatttctcctgtcacgttaaaatcacacctctgacaaattcacttatcaatcctcgtcaataggatgataagtccacaaagttactccaatcgcaacacaaatcttgtcacgttaataccaaacacctctgacaaaatccacttatcgactctccccaatagaacgataagtccacaaaattgccctgatcgcaatatctttcccgtcaagttaacatcacacctctgacgacacaatccacttatcgactctcctcaatagagcgataggtcctcaaattccagtcaagttaacatcatacctctgacaacacaaatcaacttatcgactcttttcaattgagcgataggtccataaaatactgttaggttaacatcacatctctaacagtcaaaccccccaaatgaacttgttaattcttttttcaacaaaaatagcaagtttttattataaaatccccagcggattaaagattttctggaattatcctagtgataacaaagaaaatttctgaatttcactcttagtgaaaattcatgccaagttaatactacatctctggcgttttcaattttcttttagtgtttcaagtaaaaatataacacaggaataaatagtgacaaagcctacgtattcaacatcgtaacgccaaaatccatgcctcacatgcatggggaattttatcctgaatcctaagtagggataagtcaacgcctaacacgcgttgccggttagtctttcaccataaaaaaggacaaaagtctacgtattcaatatcgtagcaggttgttattaataacgccaaaattcatgccttacacgcatggggaactttgtcccaaatcctaagtagggataagcctacgcctaacacgcgttgccggttagtcttttttcgtgaaaatgacaaagtctatgtattcaaaatcatagcatcaagcctaagagagttcattctcttagcacaacgttacatgtggaacggacttagacaatccacatgctagcccgactcaaacggtagtcggtaaaggcttatcaaatccgttgatggctgagggtttgccaaaaatcctatgtatgtttgaaggcccatcagcttaatggacgtgagccgagacttgaaactgataagctaaagacaagtctcaaagatttagtcaaaaatacacggaagccacttccatgtctcaagttcaaaacgccgaggtcagacccgcgttacaaaaatcacgacgccgaggtcacacccgggttccaaattcaaaacgccgaagtcagccccgcgtctcaagtccaaaatgtagggtccacccccgcattccagaagcaggattatgacgcataccttcatacaggtcctacatagcaaatcccttcaaccaagataccttcgaagcgagtgcagagaacgactcttttacgataaggaatcaacagctccaagatcagagttgagatccaaagtattccgaaaattcgtcccagtcaaccatgaactttcgaaaactttggagggagttctgtaggctgtctaaaaattataatagatagcttatcccccatcaaacaccgatgatggaagttataatctgacgacttccagaaggctataatttgaagactttcacgtagatcgctgaaggttacaatctgacgaccttcacgacaaccgatgagagttctagttcaacagcattcacaatcaatatcgggagttataatctgacgactctcatattctcaaggagccaagcaaagattacaaaataacgatctttgcaacgctttgacagaaagagactacaaatcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgctttcgagaatctcccaaatcttcttcgcagaagtctcattcatcacatcatattttagatcttgagtcaaacaagacctaatcatgccacactccgttcgattcatcttcttccaaacattctcttcaatctcatctggcttgccatctaacttcaaggtatcctccaaattctgcgcgttcagcgcatccaaaacctcgcatctccataatctaaagttgtttgtgctattaaatttctccacatctatcttcatagagtggatattcaaactctgaatggtctttgcgccagaagcaccaccctcgacacccgaagcaccttctttccccgacatcttacgcaccaacgaacaaagaatagacccaaaactgaatctcaatgcaccaacgaacgaagaatagatccaaaactaaaaagatacagtctttaccaaaagatcccacctttatccccaaacaaagccctagacgagcttccaaagcgacctactcctccaaatagtccaagcatagcccgagctctgataccacttgttgtgcacaacgaaaatttcggcagagtttctggtgcacaataagagagaaagatcgataagaattcctgtctcaccaagaaaacaagaatctgaagcgaatatctcaacaaagtgggatatcagctcttcctctcatcagttctaggactaatttgtcgagggaacctaataaactattacaataaccacaaataacaaatcacataagttttacgtggttcgacaaattgcctacgtccacggggcaaggagggggggggggtctacaattagagggaaagggaatacaaataggtttacaaccactcaagatctcacaaataaaccctcaatctaatctctcaattcctctctcaaaatcagcacgagagactgcacaaaactctcacaaaagccgcctcttttcttctccgtcgaaaagaaactcacagccgaaaaccaaattctcctttcactccgcccgaagccaaagaagccgtctgcagttttatttctcctcttgcacacgaaaccctagaaagaacacgctatatatagcatcaaatgacattcgggtgggcctgtcaaaatctcgctgttgttcacgtgctcctcaacgtgatctcatcacgagttgagaaaacgcgtcattcacacaaaattcgtggctcccacgagtcacgtcacgtcttcgttcgttcacaaccccatgtcatctcatccttatcatttcacgcgttcacatctcattgttaagagagattgtaactccagagttttctcctcatagtaaatttttctatccttgcccgtggacgtaggcaatcaagtgccgaaccacgtaaatctgtgtgtctatcattttatctctacttttgctcgctgcgaccatgctctattgggccccaggttggccctaacgatcttagcattactatgttggaatacaacctgtatttgacaatgttggttatgaactgatgacatcgtggaggacaacaatgaacgatatattatgcaggaacattgtatttgtgagggacagagacttacgtttgtgaaaagaatcacactatataactagccactctaaagtgttattttcatcatttaagcagaagagatggcgatctataacttacactgttaggtgctaaggtcagttatcattgtatggttctccattccctgcaaagtttaggtggtacaaggagtgtatcaatcaataaagaagatagtttcacaaaaggattgagcaatttcacgtggacagattgttaatctatcacacctactcattcagtcatcagatcaagaaaatgatgcaaatgtaggcattgttcgagagtgctgatgttgatttagcatgcgatacacgtgaaaactaaaggtcaagaatcatctgcattttgataaggatcgatctcctcttaaattatggaaggtctgttctagtgatttgaaatctttcttaatgacttctgcgcacaaacctactcctatatatatgcttgcacttggagatgaaccgtccttaaagtttctgcagtccttctcttactttacaagctggataaagatgtttccgattggattcttccagattcagtggtggatatgggagatcaaggcaattctaaggtatggagcttacattgatgcatctctccattatctctccatactcttcttctgctgaattatatctttgatataagatactaaagattgtcaaattaaagtaaaatgagggaggggaagtctttcatcatcttagggggggaatgaatcagtaaactttatcgagctttatagggaagcgaattgatcttcgttaacatttacatcacagcctatatgcactaggttatggaccattcaagtaactgaaactaaagccattaccacaagcctatatgcactaggttatgcactaggttatggaccattcaaaatctttgtcaaacataagtggggtgagaatacccaccatttgagggattaaaattccaaaatatgaccacttgagggacgaatttgaaaatgtttaacgaattgataggtggtaatttgcaaaatttataaagatttgagggactaattatgaagatgtaactcctcgtttggtacgcgggaatgaggtggaatggaatggtcattctcacttctcattcactgataccaaacgtacctattttttagaggttggaatgaccattcccaccttttgtgggaatgagcatttcaagtgaattgataaggaatgatcattcccattcaagtgagaatcaaattagttacgtaattttcaattataccctcattgataataaaaataaaccaaaaaaatctcatctcattgactacgtatatcatttttctatttcgaaacttattattttagttggtgttgttttatggatttttttttatgatatgggtgattttgatacttcatcaaatgagttaatttatatatctagaactgtggattgtggatatcattttttatattatttttgaacctatgaaagatgcgatactcttttatttatttttctttaattttttaagactaagaaatagtgagtattgtttaaaaaatataaacggaacatacacctgagagataacatgtgcattagtataacaaatagctagattaatataacctatgcataaataaaattgtttagttattatcattaatgcttatttttatcttattaaaaatctatgttgttgtaagggcattattagaaaataaaatttcattctcacttgtgaactagtgataccaaacatgggaatgagagtgagatttttattctagcttcattctacaaacgcacccaaacaagagaatgggaatgaccattccattcacacatacattccattccattcattcttctattccattctcatttgagtctatacccgcataccaaacgtaggcgcttataagtttactataaattgcttaaaaactattataaaggtagtatttgttaaacttagtctacaaatccccaacactttgtagagtttcctataaaacccgcaaaaccatcttattttcaaactacacgtgaaatcttcaaagtttcaattttatcaatttgtcctctaaatcttttgaaaaaccgttggttaactcctcagcttaacttccttgtttgcaataaaaaaaacctttttgtttttcaatttttctctatgctggaggcgatttttttcatttggttggagaataatgaataattgaggttttaaaacgcattatacacctgagccaagtgaaggcttctcatgggtctggatcttttccgctatagattgaagctaatcccagttattacacaaatccacagaatataattttcttttttcctttgtttcttgaactcagatctcgtatcctggaaaaattgattatgagcatttggaaatcgagtatacgtttgaatcaatatctgattagttatagatatttaaatagccacatccacacatatatttcatatatggttatggatacaaataccatctaatctttcataggataaaaacatggatatagataaaaatataggaatccagatgcagatacttgtatatctatgattacatcaaattcttttgatcttatatttgtggatctgaaaccaatttgcataacttatagtttgctgttatggtgaaaaaaattggtgaattatgattcggatattttatttatttagacaatttatattatcagtttctctcatttgagacatgcaactgatattcactacccagaaaaaaacttatggctaaacattacgaggaccaaaatcaatttaaagcagatacatagataagattgtttacatttaagaagaagaaaaattttatttatacagaacagttgcatcgttagaatgcaccccaaagaaattgctttagagaaagttatctattacactttggcatctaataggcttcatatcagaataccccccgtaactttgggagattatcagaaaactccccttaactttcaaaataaaagaaacccccttaagtttaggggttatcagaaaaccgcctttaactttaaggttttatcacaaaccccctaacaacatcacccgaaatatcccaaattatcggcgaacaaaagtaccacgggaagggatttttaatgggagagttttttttttcaagaactcatatagttttttcagcaagaagtcaaatcaatgtgttaaactaaatttaaaaaaatttcttatcacgcgagggggaaatccctacccggagtattttgttttgctgaaaatttgggataataagggataaccgatggtagggttttgtgataaagggggttttctgaaaatgcctaaacttaaggggagttttctgatatgttaaaaactcagggggtgttttctgataatttcccaaagttaaggtggggttttctgatattaagcctatctaatacatcataacacgttgctgttgaatccacatattctctgagaaacaacagtacttgatatactaacttagcacatttaaaacacctgtagttgttttctccactcccttcccgtagtaggaagaacaaaaaacaccatttctcaaactataagctccataatttaccaagccatgtgaattcaatcataattagtatcactatcatctgaaataatgtaatttgaaaagagacacgaaacggaacatctataacaccaaaacccatttttatatgtaatcaagagttggttctggtgccccatcttgccaatgcaaagggaagccttcaagctttttttcatgagtggcattgaaacaaaacccacgtagcaagaaatgaactggtaaacaaggttctcagaatattttgacttggaccaggcgcaactaagtcaagttacatgggagcttaaaatcgattatatacaacttgatctcggggtaaagttctcagaaaaacagtgttgtgctttgataccaattgtcgcgcgcctatgcggaagcgtgctcgctcaccaaacaagtcgtaagcacgggagaagaataaccaatcacacatgagcacaatccaaatacgacaaatcaaaccaaacacagagatatacgtggttcggcaatttgcctacgtccacagggagaggatgaagagattccactaaatcatggagagtacaaagggttacaatctcacaaaactcacaaactaaccctcaaccaaagctccactaaatcatggagagtacaaagggttacaatctcacaaaactcacaaactaaccctcaaccaaagctctcaacttgctcacaatatctccctctcacaatgctcaaaagtctctctaatctatgattacaactctcctctttttgattgatcctaatctcttctaaggcgttccatatatatagaaaacctaaaaccaaaacagactaggaattctaaaatcaaaaacaaaacaaattaggaatcctaataacctattaccaaaacagattaagaatcatgttaccaaaatagattaggaatcctaataacctcatgttaccaaaatagattaggaatcctaataacctattaccaaaacaaattaggaacctgctatccaacaattctccacctcgacgaagtattcccaaaactgagccgacaccaacatgaacaccaatgcgtcgtctcaccaaattcggctgcaccaatgtggttgcctacgtacccactctcccaagggatcaagccgccgtagttcatccaaatggccgtcaacggcctcaacaatcacgaatgtgcaacaagcttctacaatgatcaaacttgttgctcggaaccaccttagcgagcatatccgccagattatccttcgtgtggaccttcacaatctccacatcgtcatctttaagagcatctcgaacgaagtgataacgaacgttaatgtgcttcgtcctcgcataaaaaacctgattcttcaccaaatagatagcattcatactatcataatgaatagtgatggaccgctgcgatataccaagttcctccaaaaatcctcaaagccaaatagcctccttcacagcctctgttatcgccatatactctgcctccgtcatagacaaagccactgtagactgtaaggtgcatctccaacacaccggcacacgggtcaaagtgaacacatatcccgtcgtagaccgacgcttatccaaatctccggcataatccaagtcaacatagccaatgcacaattgcctacctgtagtgtcccgctcataaatcaaaccaacattgagcgtaccttgaatgtacctcaaaatccatctcacgacgtcccaatgacccactcctggatcgtgcatgtatctcgaaaccattctcatcgcctgtgacaaatctggcctcgtacataccatcgagtacatcaagctcccaaccgcgctcgcatatggagttttcgacatcaactctttatcttcaactgtctttggtgaaaggtcagctgaaagtttcaaatgggctcccaaaggtaccctaactggcttcgtatctatgctgatatgaaatcgctgtagaaccttcttcaaataagccacctgtgtcaaacaaattctgcccttcttcttgtatctgtcgatctccatccctaaagtacgcttcgcctcacccaaatccttcatctcaaactcatttgaaagatgtgccttcaactcatctataacaagatctggaaatagaggcaaccaacatgtcattaacatagagcaaaaaatagatgtacgcacctcctttcaacttgtgaaaatacacgtaaggatcaaactggctctgaatgtacgaatgaccaagcataaaatcatcgaatcgcctataccactgtcgagaagactttttcaaaacgtatagcgatttcttcaatctgtaaaccaatttatccttccctgcagctcggaatcccaatggctgagtcatatatatttttttatcaagatcaccatgaagaaatatcatctttatatctaactgatctaactccaaaccatactgtgccaccaaagctagcaaaatccgaatcgaagagtgctccaccaaagctagcaaaatccgaatcgaagagtgcttcaccaccagagagaaaacctcattatagtcaataccttcctcctgtgcaaatccgaatcgaagagtgcttcaccaccagagagaaaacctcattatagtcaataccttcctcctgtgcgtagcccttcgcaaccaacctagatttgaacctcaatggagtgccctcaatgcccaccttctttgtgtatacccacttgcaaccaattgccttccgcccctttggaagcttaataagctcccatgtatcattcttgtgaagagactctatctcctcttgcatagctacctgccacaaatcagcctccgaactctgctcggcctctctgaatgtggtaggcaccatctcatcgatactctccacaggaagtgtatacgtaaccgtgtcggcataccgtgatggcatccatatatctctcctctgtctccgaaccgcaatagaatcctgaacctgagctgtcggtccctgatcctacacaactgtactcgtatcctcctcgtcgccgctatgctcgcctggcgtcacctcagccggtactctaatagatactgtaccatctggacaatgtggagtgtaggtgtcaaaaattgcttatagatcattgtacgtagctcaagacagagagaaggtgataaacgtcatcatctaagttgcagatgatcatccaaagctaaagatcaactaaagaatacacaagaagcatatcacacaagtttcaaggcacaaaatgagcttgtagattccgagacaattacaactgtcttaaaaactatgaagaagccaacgcgctttcgagatagttgtaactgtctcagacactgtgaagaagccaacatacttccgagacagttataactatctcggaaacatggagggagtcgaccacttccgagacacttacaattgtctcggaagcataaaggaagtgaccactttcgagacactcacaactatctcagaagctaagaggagagaatgacagttttcttgagatttgtgcgtactatgtgactccataactgccaaagatctgtttgaacgtggaggagtagttacaagcgggaatcacgcccacaaccgctggaatcatgacattaaaacgtgagaaaagcagttacaaaatggcagaagcggaccacgcttccgagacagtcacaactgtctcagaaatgggaagctgaccacgtttccgagataggtttttgagacagttgtaactatctcggaaataggaagctcatcctgcttctgagacagttacaactgtctcggaaatagaagttccctgatgtgacttcttttcaactttcatctttagttacagttcctaaaggctataaatacccccctaggaccattactgacgaggagccaagcagagagagcaaattaagcagagaacttgagcattttggagcgttcttctcaagagagagagagtcttcatcaaattcgagtgcaaacagcaactttgagattccttaagatctaagcttcgacttgatcttgagaagagtgttcatcttacatcgataagatattcacttaactttttcttacttctaaacgaagcaagaattctaaattaccttcacgattcaatcagaatctgtgaatcggtggtccacgagctaatgcacccccgacacaggtaaagatcccgcgcaagcagtgatccaaacaatgatcctgcgtgtgtttctaaggagcttgtaatttgatttttattgtaaagagtagttttataaagtacgaagcttactcttctgtattcattgtaatcgataaacaattataatgaattctataacagaacttgttcctaatgcaaacacactggcgaccacagtgggagccaatggtctcgctatcgagaccgtcgtgtcgcagccgattatcaagatcccggttgaatccatggtcgaatacgagttcgactaagcaaaatttgaggaatatctgtcgtcctcatccgtaaagtcttcatcgcctcgcaaatgcaggaaaattttgtcttctaagaaggttttcaagttttttactctatcgaataccacgagtgaagactcttgcccgattattgctgaagattctactcataacacctctgctcacaataactcttctccaattaaggagtcattgaatcaaaacctaccggcactgactaagagggatcgtcagagacaacgtcaacgccgcgctcgtcaaatggctaagtccttagaacaaaccgacggggttcattactatgcggacttagagtcaaggaaacatcaagtggtccagtcgcctcaacaataaaccactcacatctctactatacttacgacggaggaatggactctcgtcaaaagggctcgtttaatccttaaagaacatatgtaaaagcgtcgtgcaaatgccgctcatgcccgtgcccttcgtcaacaaacacaagaagggaagaaggaaataatgtctaaagaatcaccaaagaacctcaaagtttggatcccaaaatccgaacttgtgcaaaaatcaaatcaccagaatacatccttcatccaagacacttacaattgtctcggacaaagcagcagtatccgagacacttgcaactgtctcggacaaagaggtcatatccgagacacttgcaagtgtctcggacaagggagctatacccgagacagttgtaactgtctcggccaaagaaaggcttccaaggcctctccttcgacgccgtcgacatccattccgggtccgtctactacatccacatctgctatgtcaccagtgaaaccgtgggtcagtctcgacctgtcaaaattcaagatcataatggaggatcgcctcggccatttatcggataatcaagttaaagccctggttaaggaatgcttgggttcagtgaacgaaccccgaataaactcttacgctgggggtcgtaaatgttctcctatcagggcaaagcaatcccagaaagagaaaattccaatttcctctcgtttggggcttgtaaagattccatgctcgcatgggggtggatctaaacatataatcttggatcgctcagaggtgacgacaagtcatcctgggtatgccaacaaggttcaaacacaaaaatagaagataggttactctagtcaccatactgacgagctgtactatcaaactaagggtggaaacaaatcatgaaaaggactgttcgagaaacaagccctcattgtgtatgtgaaaagcttatcaaagcagtgttatctgaatgcagctgctctaaagtcgaaccgccaagggtttctgtattccagagactttctgctaaaacgtcaaagcccaggccgaggcatttatgcaaaagaatatctgtcgttcaacataataaacttctagaggtcaccatcaatatgaccgacagaggaaatcgacattcaatcaatcctgatcatgatttttctccgggggggagggggggggagttgatcagggcctctctcaaagaatgtcacgactacagcgaaggaccactagatgtagagattatagaagaatgcatgaagagttgtcttcagatgaggaactctcagatacttgttctgcagttacctctgatgatacaatgtccagtataggacaagccagggaatcattcacaattacacctgatcaattagcccagatattgcaagaagctttagctaagcaacgagaagaaattagagctgaaataaaaacggagatggagttgacgatgcaacagatgagggatttgtaggcctaacaacatctacaacaaccggaatcaaaccaaaaggctgattctagcaggcgtaatactatacctgttcggataactgaggttgatagtgaccaagatgtggatgagaccaacattgctgatcctcctcctactaaagataattttgaaggtggtctagtcaaatcgtctatctaaccttcttaaactcaccctaaaaagaatatggatgaagacaagaaaatgcaggaccttgagaacaaagtcaatgccctgatgatggctcaagaagtaaagaaaacgggcattccatgcccatatccgagagagtcggactcaattccttatcccccaaaattcagtttaattaactttactccttttgatggcagggattcacccactcaacatttgatttatttcaagtcccatcttggtgcaatattcagagaggaggctttgatggtccggtcattcgtagggacccttcgtgggcctgccttcgattggtaccgacgtcttaagcctggaagtatcaacagttaggatgatatggaaggattgtttcttaccaatttcttcgatgatgacactgaggcctcaattggtactttgttggatgagaaacagaaagatggagaaactgtagatgtcttcgttaaacggttccgaaacaaagcggtaaattgccgagatccgctcaccgaagaatttatcctccagacatgtcacaacaatctttctttggatgtcctagaagtcatgggagttgtgctttctaagacttggaaaggattaaaagtatggggtgaacaggccgaatgctttctcaagaggaagaagcttgagagaggtcagccactaactaatcctcaaaagcagaattataatcctcgaggtaaaggaaagggagtcacaagtgctgttgatgctcaccaaacgtcgcaacaaccacaacaacaacaacagtcaccttttcaactatcacaacagactcaacagtcgccgaaacacccaaagacttcagaacctagattcccaaaagaatactctttcagggacgatgaagtaccggttattttcaaatatcttttagacaacaacaagattaaacttccaccggtcacgaatcaggaagaagctaagaagactacagacccgaaatattgtgcatatcactatttttgtcggaaattgttttcattatggaatccattaaaaacttcagtcgcttacaatgaattacacaacaaaattaagaaagttacaacttcctggaaaataacatagaaattgtttatcaactcctgcttttgtgagatctttgcctgtgccgggggtgcgttagcctatggaccaccaaatcacgaattttgattgaatcataaaggctttggggattcttccttcgtttagaagcaagaatagagtcagtgaatatcttattaaagtaagataaacactcttctcaagatcaagtcaaagcttagatcttaaagaacctcccaattgttgaaaggagatgaactcttgaaattcgccaagccttttgaaaatctctgaccaattgctccagtaatagcctctctgttctatgctctctgtgcctggattcttctcccaaaaaaaagtgatcccaggggggtatttatagcccctaaaaattgtaactgaaatagaacatcatagggggaattgtgcttccgagacagtcgtgactgtctcggcggtcgagacagttatgactgtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagatagttatgactgtctcggcttccgagacagccctgactgtctcagaacgcctgagctgcccaatagtttttttgtaaccgctctcccacgttttaataccattattttggtagttattgacgtgattttcgctcgcaacgtctcccacgttctttgacaattaatcgtcacgtgtcatgtacatgtcttggcaacttccgaactcctcagaactatctcggaccgtgagatagtccacactgtctcgcgatgcgagacagtccacactgtcttgggttttccgagacaatttagagcgactattgtgttcttttgatctttgagcgttcgtattcatcgttcgtatttgtaaaatgatccgtaagccatttttagatgcctacagataccccctccaaagtatcacagactcattcttttaatagaggagtctgggacactttgaataagacatgtcttatttgcaatccctcagtacttagttgaggagatcgtgtagaaggacctgtgaacggcttcaactattgacttcttcatcttttagtctacttagtgctttgtagaatagctaaaattctttcggtactgcatttatcgcttgatcgttgtcgaaatcttaaactgaggctggtgtttcattttgtaannnnnnnnnntgaaccgatgttgaactgattgtctttgtcgggaattcatatctggatcgcaattgaatcccctggaatcatccattaacttggaatttttccttagccttattttggcaaaaatcattgacgcgttgatcggcgttaacatagtttatcctcattcgtttactagagtctacacagtttaagctcttgtaggctgtctaaaaatcacaatggatagctgatccccatcaagctccaacaatgaaagttataatcagatagctttcatgccaacaaacgaaagctgcaaatggaggacttttcacatagagcgagaagagttacaaatcaacgacacttccgagaactgataaaaactctattcagcagtcttcacaatttacagtgaaagttacaatctgacgactttcacaccccacaacagctaatgtgaggattactgaacaatggtccttgcaacgctctacagaagaagttacaaatcaattagcctcttctaaaacgcggaactcatcttcgcgttacgattcttgaaatgcaggcgacccccgcgtttccaaactgtaacaagcaaaacacgagtggccctcgtgtttttgacgttcagtcaacacccaaccttgcgtcttaattctaagacgcgaagttagggttctgaacgccaaattgggcatttgactcattcaaatatgagtcgaacggtttcagaaccgttttccccatgatctgaggaaatcacgcccacttaggagcggatttagagggcagttataacctcttatccacctataaaaactcaacaaactcaaccgagtaaggggttggctgatagattagattttgagcatctaaaccgcacaatgaggtttggagcttgggatttttctctggagatagcaaaggcgaattcttcaaaacagaagatttaactcagattcagaggatcaaatctaaaagaatccttcagcaacagaaaatctgcttggccattaaccgaattttcggttctaacaactcttttcacagaattctaactcgttctgagttcaaaaactcgttaagagttattcattaaactttccacagaagttcattgttcccacaagataaaagatggtcggatcgtcaatggagagcaaattcaacgcaagcaatcgaaggaggcactccatcgctaccaagaagaacccagttttaaacaaaggggagaatcaaattcattctcctctcttttgtaatcaggaaaaccaaattataatcgattttgagagaatacaagttaattttctttcactgtctttttactacaaattttctacaaacaaaagatgacgactctgctggggactagcttttctaacgaggaagtggtggcgtaatccgatgttcacctcatgggaataactgttgaaactcttgtcgtggagtttgaccaagcaaagtacgaggaagccctctcctctggatcgcttagccccaaggctaggcgcgacgtccgcaagatctccaaggagatcaaacctgttactgaaacgccaaagaaagtcctctcctttggccaaaatttgttgaacagcccctccactttaggagcgggcttagcctctgctgatcttgtccagcgagttgaatgtcccacatccgcgtcaacacgatgcgcttcaggccataaacgacctatagaggagacgagctccataaacgccaacgacgttgctgccaaggctttgaaacaagccaaaaagaacgccgctcgaagacggaaaagatccatacggcgagcacacctgcgcgaaagccgaacactggcctaacgcgaagatcacgttcttgaggctcagcccgagtgcagcgtttccactccagaacgtgtacttcgtgataatgagcccaattacgagcctcgactgatacagctgaaatgcgaccctcagtgatgcgttatttcttcaaaacacagccctcagaaaggcgctgccgaagataaacgcacacctcacatgtgcgttcaaatgaaacatgaccctcaaaggtccgtttcaccaactaaacacgatcctcaggggtgcgttcaaccaaaacaggaccctcgagggcctgtctcatcatttaaacataggcctcatcctaatgtttacaaatccaaacgcgaccctcgcgttattcctcaggaacgcgaccctcgcgttattcctcaggaacgcgaccctcgcattgtttctcaagaacgcgatcttcaagaggtccaccaagttcggaaaagtcaacctgggtttaaaatccacgttcgaccagaatcaatcttacccactcaaggacagggggttccatctccgtccccatgctcagggagagattcctcccaagttcctgatttgcgggaattattgtcaaggggaaaaccagcgtagcaagcagctcactcatgccaatatgagcggcttatctcggcagtcctttcagaatgccattattgcgcatccgtacctcggcagtccgtgttcaacaggttgacgaacattgttagacctgccaaacaacaacgtcgatacaaaaagaagacagccgaaactgaataccccgaagtcactataaatgtgataggtagagggaaggcttcaggtcccagttctgaggagtcacaaagaagtcattcaccgactgttcgggaaatttgtgacgagttcgaaggagtgtacaggcatactcggactcgaacaggaaccattcgctcggttaactaccaaagattagccaaggggatcgtttctgatgatgaacatttggcaattgccgaatctcaatcttcaagctctgttgtggcacgagaggttttcgcttacatggtaggaaatcctgaagacctagctaagagagtagacgaacatcatgtcatgctccaagcacagcaagaaacacttctgcaaatgaaggacatgttggcccagctccttattgaaaaaggctaaaaacctgaatcttcccgaaggacaatgtcaaagggaaagcagaaggcacaagaacattcggattgtgaaactcacaacttggaatcctcttctgaaaatgagaaggagatagaaagagaattgcatcctcagtccgctaaagtggacgaactggaggctcgcctcaacgcaatagccaacagaagcgagctccgcgaagaaggagtggtgcggccttatcctgctgagtgggacacagctccttacccaccaaagtttaaggcccctaccttgcaaccgtttgatggcacatgatcgccaaatcagcacatctactatttcaaatcacagactggagacgtgatagcaaatgatgccatcctgacgcgcttgttcataggcgctcttaaaggagtcgccttcgaatggtttatgaagctgcatgctggatctattcagaaatgggtagatttagaaaggcttttcttagctaggttcttcgaggacgatacagaagttttggtcctgactcttctcgctgttagaccctagaggggggggggtgattagggtcttatgctaatctaatctgattaaatgccaattaagattaattaacaagttatcctagcaagtataaaatacaataatgtatatgagctaggataagcaatatgaacaacaagatatatcctaacaaagagatataggcaatgtatgtgcaaggatatataaacaacacaagggtaaacaatctaaacaagataggatttgaccccgtctctcaccacacacttctctcggtgtacaagtgtattacaagtgaatcctcacaattaggcacaatatgacaaatgattgttctctctaacaaggtgagaactcaattaagcacaactcttagtcacaaacccacaaccccaaattatactatgaatgtaaatacaataagctcaataggttgtgtgtgaacaaagagataaaacaatataaactcaatatgaaatctagcttatgaaattaagaacaaacttataaaatgctagaattgagtttaaggaaacttctctatagatgacaagagagagggagaagaatgaatgctcaaacaccaaggatgatctccacttgctcttgtgaaatttgctccacaaatcaaacttttgtaaatgcttaaaagctttttaaacaaacaccaaacccttaaacaaaacttgtaaaaacctcttaaaaacttttctcttgttaggtgggagaggtaaatgcaatggggtatttataacaacccaagacatcagccaaaacccctaacaaaagataaaaacaactcggtcgaccgatgagagcaaatagccgttggagtgcaacggatctattgtcggtcgaccggaaattctgtcggtcgaccgatggagctcttggtcgaccgcaccagtcgaccgaccatctctctgctgcatggtggcgaaagaacaaatgatcggtcgatcggtgcggtcgaccgaaaactgacacagtaaaaaactaatatgctgatttaaaacactgtttaaaaatatcaaataaattccaaaaaatgtaaaactttggggaatgattgtagacatgataataaacatgctacagtgactggttatcagaaaggacctcccaaaagaaaaatatcatcattttacaaaatagtccaaaacatgaaaatatgagatacttgaattttgatgttttgacataaaccaacttttgaaactttgtaaaatgtttttatagacttagtaaaacatgtataaactgatattaaagtctacaaactaagaatacaatattttcacaaaattgcatattctatgcaatgttttcaaaaacacaatagaaaatataaaatatataatttcatatatataatcataaaaactcaaaacacatgtatgtatatatataactatatatatgcatagaaaccaaaacttatatatatatatatgactatatatatatatacgaagaaaccaataaatgtgtgtgtatagatattgagcttagagtatataacacacataatataaatcctaaactaaattacccaagctagatcttgatcttcaataagctcttctaggtaatctcgcggatgaagctttaacttggatcttgaactttgaatagcaaggcttcaccgacattccgccaacctcctttggatatgatcgttgaagctctattccatccaatatatatatatatatatatatatacgaagaaaccaataaatgtgtgtgtatagatattgagcttagagtatataacacacataatataaaatctaaaactacattacccaagcaatcttgatcttcaattaagcttgacttggtacacttgcggatgaagcttgaacttaatctttaacttgaattgtacgttgcttcactccacaattccgccaacctcctcttgatatgatcgtgtaggctcaatccatccaacctccaactcgttgtttgcctagaataaatacaaaaacacaaacacaaacactagacaaacaacattagtaataaattatttgttaaacatcattaaaacaagaaggccaacactcgccaacaagcagaggaagagagaatctatcaagacctatgtggagagattccgcagcatggcattgcgatgcccttcaggtatgactcaatcaactttggttgaaacttacaggcacaacttgcagacccagctccttgcttagataggagtagtggagtgtcgctcctggagacaactggtttcgcaaggagaacaagctgaagaaatcgttgctcgagttaaagctgaagaagtgacgcaacccaagccacagcagcaacgcaatcaacacaatgcccagcggtctaagggaaaatagacttttgtggctgacaccagcacgcgagcaccacctcccgctaagcaaggcaaggcgccaaatcaacaaagagcgctcaagcagtattcgtttaaagaggagcatgtagacaccttgttccaattgcttcggaagaacaacaagttgcagctgtccgaaattaggaagccggatgaagcagggaaggtggatgaccctaattattaccgttatcataggttcctagggcatcctaccagaaaatgctatgtcttcaaagacatcctgcaaaatttggtgaatgctaatgtgctcactttaaaacccgagcagaagaccgtatccaccaacatgatagcggtccaattcggtggcttctctccgatagcgactacagatagcgttgtccccattcgtaaaggagaaatgcacctgaagaatgctgacttgcacaagcagaaagatagggggttggtacccctcactaccccaaaaggggaaatcatgtgggtccaccctgatctgctaggagaccaacagtggacaaacacctcgtccaaaaagaagggaggcaaggctaagtcttccaacatgataagcccctccgttactgagaatgatgatcacctcaaacctcttaccgattcagaagaagagaggattgtcctgacagcatacccgggagacaatcctagcactcggtcaggaaaggcttacttgagagactacaaccagaacgctcaagaagctgaagaacagccctaagacgctgggggttctgtaccaaagaagccggtcgataaagggaaacaaaaagagcttcggttcaacaaaaacctccaccaggaatttggggaatcgagctctcctttccaattcaatgtcatggcgcagctggccaatataccggccaggattactctatataagctcctaagattgtcgaaaaccactaaggaagctctaatcgaagccttaaagaacacggagagctttatcactcaagttactccgatttctgaagcttctgaagaccaaacctgcctgtaatgtctacaagcggcaaggagtttaccttgcatatcatttactcaggaagatatgcaggttacatacaaacatgacagacctctatactacacagggtatattgggtcgtcagaaatcagtcgtgtccaagttgacccgggatcagcgctcagtatcatgccctacagggtcatgcaggtcttagggattcccatgcatcgactaaacactactcagactaccatctttgggttcaatgtaaacaacactcggcccctggggaagatcaaactcatgtgtcaaatcagagatattaagtccgaagtgacttgttacatcatagatgcggacacgtcctacaatcttttgctaggacgaccatggatacatgcaaaccgcattgtcccatctaccctacatcaggtcatgaagtatgccaatgatgagggagaagttcaaaccctaattgcggaaaaataccctttccgaggagtgaaaaactttcacaccgactccgtcttctatctggaatcccaggagaaagaagatgtggatagcggcaacgaagccgacattgaaccggatcctgaagaagattgaccatgggaattgaatctaaatgtaatgggtcaggacgagagtaataataatgtaccgagtgagggcgagtggtgcattaatgaagattttattttggcgtacttgtctgatgtgtcctctaaaaataaacaaatagagaatgatcctaatacaggtaccaacccatggcacgcactgtgcacagaggcatcactcacattgccaatcgagtcatccttcgcttcagatgaaggagtagaagatgcacagaaggctttattcaaagtcccatccaaaaggaaagggcagaagccgatctgttttggtaaagtcaaacacgaacaattcaaacgaggaagttcagaggaagatgacgaagttccccaattccattaccacgaacctaattctatacacttaatgaaacgaatagggtataagtttaatgaaaaatagggtttaaactccgggaaaggaaggcgaacaccaattcgaatgtctctaaccctccaaaggaaaacctccggactactatcaaaaaaccggaagaggtgtaggctacgtcacaaccccctctgtcttagaaaataaaatcagtaattatctgcgtcaggaccattcatccgggacatcttcttgagaacccaatgtcagtgtcggacctttctttaaaaatctgactgtgaatatggtttcaactagtcatccagataaagacgcagggggtgatgaagagttaatcaaatcaaccaatgatcattggatcaaatgcctcaacattttgtgggatatgtgcttcgaacaacgtgaacctcccactgaagatagagtgattcaagtcaacataggagatgaacatgaccctaagcccattttcatagctaaaaatttatcatcatccgagaaagaagaccttatatcgcttatttgagagtatatagatgtcttcgcttggaactatgaagacatgcctggccttaacccaaaagttaccatgcatcggcttaacattgatccggatgcaaaacccgttaaacaacaacaacgccggtttcgtctagagatcatggaagcaattgagtctgaagttaaaaagcttatagactcgggttttgtcagagaggaacaacacccagattaggtatccaatattgttccagttcccaaaaagaacggtaaggtcagaatatgcatcgactttcgtgacctcaacgcagcttgtccaaaagatgagtttcctcttcctatcactgatgtcatgatcgacaatacctgtggatatgaaaggatgtctttcatggacggattctctgggtacaattaaattaagatgcatcctgaagacgaaaagcatactacgttcagaactccactgggggcgtattgctacacagtgatgcccttcggcctgaaaaacgcaggtgcaacttatcaacgcgcaatgaacgccatctttcacgaacacctacgtaagaagatcgagtgctacgttgacgatatagcagtaaagagccaacataaaggcgatcatcttacagacttgaaaacaatgttcgatatcatgcgagcacatcaactgaagatgaacccaacaaaatcgttccttgggggtatcaagcggaaaattcctaggatttatcgtcacatccaagggaatctctcttgatccagagaaagtgcatgctatccaagatatgccacctccgaagaatctcaaagaactcaggggattgcaagggaggctggcctacattcggagattcatatcaaatcttttagggcgctgtcaacctttctctaagctcataaagaaaggagtatcctttgtctgggatggggattgccaaagagtattcgaggagattaagaaatatcttaaccaaccgccggttcttgtagccctaatatcgggaaaaccattcctgttatacgtgagagctatggaccattctctgggagctttattagctcagaacaacgatcaaggtcaagagcaagccatctattacctaagcaggactatgatgagagccgagcaccggtataatccggtcgaaaaagaatgtctcgctttggtatttgcagttcaaaagatgcgacattacctagttggacaaataattcaagtcatctctaaggtgaatcccttgagagttctgatgatgaagccatcatctctaaattgtcggctcgtaaaataggccattctcttgtcacaatatgacatacaattcatgccccaaaaggcggtcaagggtcaagcactggcagacttcttagccgattatccggtgccagggacatctaaattgtacgaagaactacccgatgaagtcgctgaggcttgcgttactcaagaagctacgcaagtgtggaaattattcttcgacggtgcatctagagcaaatcctcatggagcaattaccacaggagtgggggtcgtactcgtttccccaaacggtcatgtgatcccaagagggttttcactgatcgaaccttgtaccaacaatgtagccgagtataatgcgctgctattaggaatgcaatttgctgaagaactcaatattcgacatctcgaggcttacgatgactctcagctcatcgtaaatcaagtccgaggggaatacgaggtgcgtcatgaggatctaatcccgtactacttcgcagtgctaaagcaagctaaaaggtttgaaggtttctttattgaatacatttcgcgggctcagaacgcttatgcagacgctttagcctctttggcaacttcactagcattgccaccaggggctgaaacaatgattctagtcacgggacgcgagctatactattacaagattcctatagaggaaagctcggacaagacaatgacaggagaagtctgtacaacctctatggagttcaaatctagggattggagattcccatatatcgactacgtcctgtacggaatcctgaccgataaccctaaggaagcggcctctatcaaacgaaaggccctccgattctattacgatgcagtttctcaaatcctgtatcgtaaatcacatgatggagttttgcttcgatgcctctctcaaaaggaagcaaaagaagccctcaaggaggcccatgacggaatgtgcggagctcatcaacccggagataaattagggaatcgcctccgacgaattggctattactggccaaaaatgttcttagacgcagtcgactatgctaaacactatcacacatgtcagattcatggagactttatccatcaagcgccaggtaacttacatcccacatctgcgtcttggtcatttgaaatgtggggtatggatgtcgtgggaccaatctcacctccgacttccaaaggacaccggttcattttggctataaccgattacttctccaaatgggcagaggcagtccctctaaaagaagtcaagacaaagaatgtgattaagttcatcaaacatcacgtcatctaccgctttggagtcccgagacgaataattcacgataacgggacacaatttgtcagctttggatttcagagattttgtgataagtttagaatccaaagtgtcgcatccacggtgtattatccgcccgcgaatggtcttgcggaagcttttaacaagaccatcgtgaagcttctcaaaaagtttatttccaagagctgacgcgattgggacgaaagacttggagaatgcctatgggcctaccgcacaacggtgaggacccctacgagagcaatgccattctctttagtatacggctgtgaagctgtactgccacttgagattcaaatcccttccttgagagtcgcgattacagctggactaacagaagaagagaaacatcaacgacgtctacaagaacttgaagccttagacgacaaatgacttcaagctcagcaacagatcgaattctatcaagcctgtatttctaaagcctacaacaaaaaggttaaagaacggattttcaagaaaggcgatttagttttggccaacagacgacccatggtgatgacgcataaaaccaaagggaagttcaatcccaaatgggaagggcccttcgtgatagaatcagtctattcgaatggagcttatcgcctcatcgatcaaaaaggagacaggctcatgatgccaattaatgggaaattccttaagagatacttcccgtaaatcgtgtagcccccttccttctctgttaaaggctagtcaaattagactgggggttgccaattcagagtgtatttcaggaataatagtttaattttcctgttttgtatgtcatcatgttaacactacacctctgacgattgaaattttctggaattattctaagtggtaataaagagaatttcaattttatgctaagttaacactacacttataacatttgcattacttttcattgtcctgaattagaatccaacaaaagagacgatgaaaggcaaaatgatatcattttcattcaatattgttaatctaaatacaaagtgatggcaatcgaaatgaaaacgataaaaaattattcctcagccaaaaacagtgcaaaacctaagcatcaggcttcatcaacttaagagatttcagcctggacttgaaggcagaaagtttctcttggtgggctgctcggacctgtccttcaatctcctttctaagttctgtttcaataggagcagcagcaacaatatctctgcgaatcctctcggccgcgtgaagcgtacggcaaaaatctgtataaatctggctgctttgaagctcaagcctttttctgacatcttcgtattgggccaattgtgctttcttccggtcctactcatcctctaatcgagtaatagcttcttcagtggcacgaatgtcagaagcaacacctttgatattagtatatgcttgagagtgctgcttccgtaagaaggatatgcgagcctttttatcagacaagtccttgcgaaggatctctcgatgatgcagctttgagattgtggctaaggagagagccggctccacttcagagttcagattggtatgctgcagctctttgaaagctgtcaactctgcctttaggaagatgatgctccctttacaatgctcagtccatgatacatcacccttatccctgactttatccaagcacttgttcaggataggctcacaatcctcaaaggaagctccctcaacactgacgatattaacagtcgtctgtatccaatgttccaattcctcaattaatttcttcaaagctctcgagcgtggaggaggaatggttggatagatcagacctgtatgttcatcccggaccggtaagggaatgacttcggaaggagagccttcatacatactttcatcccgggtaagagaaggagaagtggattcagaaccttcaatgggcgatacctcttcggctccagcatcctcaggaatagaagggatcgattggggcatttcgtcctctctatcagttaaacgcgcaacaggcgtagacttcatcgcgtcccccagtaatttggccctattggaattcttagcaacgataggtattctcttacgaattcttctgttgtattcttcttcctcggcagcggaaagaaccttttcccccgacgatcttaaggcacgaggttcaggattcgacacttctgcaggaatctcctcagctgtcttttcttcgggagaatcagcaattggtgttccctcttcggtccccataggaacctcttcctcagaaggttctgtggtgggcaaatccctaagggcttcaacggctccggcagcttcccattcataggatagatattcttctatccccggtagacgagtcttcgtagaaccgctcctaaaacgatataattcccgaatctcatttatacaggaagtataaatatcatatgctggtatttgagaagcctcatcaaaccagttgcgaaaatctgcaatggtagaatagccgggcggtgaattaggtaaagtgaagtgcgcgtgggtccctccggcggagaagaagtaccatgcgcgagctccttcatacaaattcccaatttgagccaacgccgggttaggattgccaacgtaaagttggtcatatttgaactgtctagcaaattgagaaggcatgtaaggctcaatgatgcacttctcccgtaagcgatagaccagatagcccaacctgatcatgagaagccatctgaaggtgccttcttctaaagagaatgaaccctcaaaaagcacgtccatgaagcgggtgttctcctcatcagccccatcaaaattaggagcgtaatagaaaatccggtaattgtcttcccgggacaaaagctgtcgagccctgactatataagaattagtccacgtggctgactccaatctctgtacaaagggaacataagcgtcgtcgccctcagatactcccgtcatcaatgaagggcaatgcaacacgaaccaggccaccaaatatgtatatggtactggtacacgtggttgagaagccttcctagctttcttcctagcaaccttaattcccggggcgccgagaagttcggaggtcaacatccgtaagccgctctgtatgcagcttaccatagcagtgaggagactcacatgtctcccatgcgctagtaaaacaactgggtacacaacctcagctaatattgcctctactggttttgacggtactacacaccgcttcaaccaaatcatgaagaagcccgcaagaagagccgtgtcagaaataggaactgtggcttggtggtgaaaactttcaaattcaacatcagcctcaaaatcatcctctgcatactctgtcttgtaagtagcactggaagccttaattcgggttttagcgtccttaagagaaatggctgcaacacgagatacaactacgtctttccggtttaagttctgaaagaggtattccgcccacacggtatgcataatgccccctccacgcatcccaaagaattgagcacatatatggaagtgtcacatcaactcccagaaagtagcagggaaagctcctcggtggtagggatgaattcctcgtagggcattctaccaaacgacaaccccgatactgcttgcatctcatggagagcaaagcctaactcccctataggtgtgaagaatgtgcagctgttcgggttatatttctccaacatagcgaagaaattgtgatagctttgcacaaccccccgtcgagtagctaacatgggaatggtgagacccgattgagcgagtggttccttaagctcctcaagaacaaagtcaaccatacgagtccaccaacctccttctccagaacaaacccaccctggggatctgaacatctgggtagagaattcaccccgagctgtaatgaattggcgaatgaagatattcgctggacgtggcacctctggaatgagatccttcttctcaaataagccgggtctcaaccccttgagttgtcccctgatttgtgtacgagctcgccgaccaaatccaagcaacacattctctttctctttgactatgtcaaaagtcaaacccccgcgacagctcacgttcaagaagtaggaaagcggatacatcctcttcatacttgggaggaagaggaaaaggttaccgactctccgcagtagttttgactcccccgcatgtatgagatgatcatcaattgctatacgatctccgaatataaatgctggtttgggaaactgagcacgaccgataggggtctccatgtccaagtcagtgattaaaattctgagagtagagcatcaggggaatttaatcatgttcgctctctccgagtcagggaaagtacacagtggaattctgctctaaagactgaagacttcattcgcgtcaggaccgccaatatatccaaaatgatgctcttgtgaaagcggcacgtttgggagaagcactgcacaatcaaaagcagagattagcagctaaaagcaagctgttaacataaatacagaatctgaaacacaaaaggccagcctcatgtcagaaatctcaaacgtgagagtcgagcctcgtgttagaaatctcaaacgcgagagtcgagcctcgtgtcagaaatctcaaacgcgagagtcgaacctcgtgttgaaaaacttaaacgcgagagtcgagacccacatggagtcccaactccgcgttttcattaaacagaaacgagtcatcttcctcgttatcaagaacccatatagggttttcaaagaacttgccaaggcaagttgttttggtcatcacttaccatgacagggagacccccgcgacggcgacgatgacgttcccgcaggaacaagaacaccgccgacgtcctcagccgacggcgttttggaagtcgctccagcgactttcttggatctagggctcattcttcgtgatgccatcgatataatcggtcggagaaggcgtcgtcggtcgaagaagatgaagttcgtcggagatcttgtcgaaatcaaatgagagttctcgttcttggaaatagccaaaaatggaaagagtcgaatgactcttgacatgaccactcaggtctatttataacagccgtcaagctgttaagatggcacaggattctaggagaatcccaaccattttatcttttaaaacgcaatctttcgtgtttttagataaagtcagttaagactttaatctcaacgtgaagttcacacccacgttcaaacgctaggctcagaccagcgttatgaaggttcttaacctcgcatttcgtacctcaaatgcaagagtcaccttagcgttgtaatttttccaaatgaagaatctacccttgatacttatcctctaagttcatggattctttcaacagagtgcttttaaaactctatatttctttaacataatctaaatactcatcaggttaatattacacctcagatgatcatcaccccaatagagattgaatttagttgtcatcactaccaatatgactacaattcctctgctaaggtccatttatcgattctcattaatagaacgataaatctccaaaatcatccaaatcctggttaattggtcaactctcttcagcagaatatcaaataaccaattgacctaattcttttcgatgggatgataaaaattccccgaatcttgttcaaatcacaagtgatacaattcatcgccctgataataaaacacttagcagtgctccccaatgagatgctataatattttttcctcacagatgtcaccttaaaattacacctctgacaaaatcaacttattgattctcatcaatagagcgataagtcctcaaaattgccctgattgtaatatttcccatgccacgttaaaattacacctctgacaaaattaacttatcgattctcgtcaatagagcgataactcctcaaaattgccttgatcgtaatatttcccatgtcacgttaaaattacacctctgacaaaattaacttatcgagtctcgtcaatagagcgataagtcctcaaaattaccctgatcgtaatatttctcatgtcacgttaaaatcacacctctgacaaaatcaacttatcgattctcgtcaatagagcgataagtcctcaaaattgccccgatcgtaatatttctcctgtcatgttaaaaatcacacctctgacaaatttaacttatcgattctcgtcaatagagcgataagtccgcaaaattgccccgatcgtaacatgccaacagtccaaccctcatacttgaacctttttcctcagtggattaaactatttcctaaattatccctaggaaaatttgtgagtttcactctatgaggaaattcacgccaaattaaaattacacttctggcatttatagtcttcatttagtgtttaaagcgaaagcgtaacacaggaagaatcctattagttagccctattttgggagaataataaagtgtttattctcagcagttagaaattttctagagttatcttaaaggataataaagagaattttctaaatcagatctatcacggaattttgtaattttgttgcttcgagattaaaacatgacacatgcaagaaataatgagaaactaatatcacttttttttatttcagaaaccaaaaggaagtgatacagagccattcttaagaaaaagaataatacaaggtcaagtcaaaagaagcaagttgagctttggcatcagaaagcttttcctcatgattagcccgtacaacggcttcagccttcctccgcagctcatcctcagtgggtgctacttcagtggctgcctccttcttcgctctttcaagagcctgagcttcttatggtaactcaaaagagtgtccgcgtttttggcaccaagtatattaacaacggcttcttcgcgagaaagttgggccttcaatctcagtacctccgcctcagcttcgacaagttttgtatgaatgaggtccagagaagcagtagagagctccagttctttttgtcttagatcgctctgctctcgcaagtgcgtaacttgaagctctttttcagccagaccccgttcaattgcctcacggtgagtcacttcctcaacttggaggtcaacaaaagtagacacgatctgtgtctgaatgtctgcatggctgaggacttctaagtgtttgagctgggcttctaagtgagaaatggcttccgaacaacgttcaaagcattgtgcattgcccacacttttgactccatttaagcctgcttctaagagagacttaaaagaatcaaagcggcctcgaccaaccgtgacaacttcaatcaccttcctcacgagactgttcaaataactcagggaaatatggaggaagtcaggagcgtccgttggactagaaaaagcaatggaagatgactcgacgaccctagaagtggacttatcaaagtacggactaacaagtgatctgggtgtagaagtcgtggaagcaactgaaacatttaattacgaaggacttgaagtcaaagccatcattgtccttgcctaagacgtgcttggtccggcttctgttggtgcaagtaaaatcctcatcaatgctgccggtgaagcaattgccgtggatgaactgggcaaaggttgctcttgcataggagctgatacttgcacaagctgttgttctagagaaggagtcacagtaatagctccgggcaatgttgccggtgaaacaggcaccatggatgagccaggcaaatgctgctcttgtaaaggagctgacacctacatgagctgttgctccgtaggaggagtagtaatgatagtcccgggaggaggtgaacctgcacgaaaaaagggtcggaacgcggaaagaacatgtggaagaattcgaagaaaactaggcttaccggagatgtgaaaaggagtataaccagacgctttatcggatgggaccttgggagcatcatcaaaaatggttatgtcatccatagaattatgctcttcgtcctccacgtcatcacctggcatgttgccaacgccagcatcctcatcacctctatcttcatcagctgcatcaccaatcgaggagccttcataatctacttgctcctcatcatcctgtatagctgaagattcaggaagacttgtgccagtagctagtttagtcataagtcccgttatcggactaggacataaaccaccagcctgtaacattagtgctgaaggaggaggggatagattctcttcatggccctgggattctaacacaggagccctaggagggtctgctactggagcagattctgcatctgtggccattaattcattctctttatcctcggagggatggtgagaagaagcttcactcgataaagccgggccttacgaaggagcccagttctatggggaaggcctgcaactaaagattcatgttgtttttcatcttcaacagctctgatagcattagccatcaactttggtttctgctggcctttaggaggaggagacccaaccatcagattccgacgggtctgcttatcgtattggccagtttcatccaccgaaagttttctcttcccagctgcccctgctgtggaagaatctaccaaccggggttcctccactggagcaggttcagttgctttctcctctccctgtccagcagaagggtcctcaatggataaaaattcgtcaattcctcttaggcgggacgtctttgatcccctccttgaagcatacatacgtcggatatctttcagacaagacgtatttaagttgtaattgggagtctaaaaagcggcaaagtaccagttgcagaagcttatggaagtataagaattgggtgttttgtggggaagcctgaagatggctttggtacaacctgccacagaatagtaccaagccctagcccccttatataagttgctcacaactgagagctgaggtcaagggttcccaacatacagctgattatacccaaattggcgagcgaacctataaggctggtagggctcgaggaaacatttgtcgtcttgccggaagaccaggtagcctggcctgatagaaaggagccaatggaagacgcccccgctcaactgggtgaatccgttaggccccgtcacgtcctgatactctgctccatagaccccgccttcaaaattgggaaaacaacggaagatgtggtagttggtgtctcgcgacaaaatctggcaaatcctaaccatataaccccccctcccattttgcagattctagtcgttgtacaaacgggatgaatgagtcacctggaggagagggtgcactcattatggaaggatagtgaagcacataccaagccatcagataagtgtaaggcagtggtatccgaggattgggagttttgaaagccttgttaccaccagactccacctctgtaacatcaataaaatccaaagccaactcacgcagcccactctgcaagcaacccaccatggcgtaaagtagattcaatggcctcccgtgtgccaaaagaacagccgggtaaatcacctcaacagcgagagcatcaattggcctggtaggaacgacgcaccgcttgagccacaacatcaagaatccagccaacagcgctgtgtcgaaaattgggatcagagctttatagtggaaactttcaaactccgtatgagtcgagaaaatatcttccttggcctcattggtataatgggaggtagcagcatcgattcgggcttaaacctcctccaaagtgctggcagacaatctggtcaccgaagctcctttattggtcaggttctggaataaatacttcgcccaagacacttgtttgatgccacctcctcgagcccctatctgctgcatacaaatgtggaagtgacacatgactttccaaggagtagaataaatttcgggactcgcttttctcaaatttttaaatttcgtcgatcctggaacaaattcttcatatggcagatccctgaaaagaagacccgagacgtggtgcatctcgtgaagagcaaagcctaactctcccaccggggtgaagaaagtacaggtctcgggattatacctctctaatatagagaagaaaaggaaataactctggacgatcccaaacttggtagctcgtactggaatctccaggctagcttgagtaagagatgcctccaactccttcagaacaaagttggtcatccgagtccaccatcctgtcactggagaatgaacccaaccaggagttctaaatccttgcgcagctcaaatttttaaatttcgtcgatcctggaacaaattcttcatatggcagatccctgaaaagaagacccgagacgtggtgcatctcgtgaagagcaaagcctaactctcccaccggggtgaagaaagtacaggtctcgggattatacctctctaatatagagaagaaaaggaaataactctggacgatcccaaacttggtagctcgtactggaatctccaggctagcttgagtaagagatgcctccaactccttcagaacaaagttggtcatccgagtccaccatcctgtcattggagaatgaatctagccaggggttctgaatccttgcgcaggaaattcccccttcctagtcataaatttcttaataaaggtattcgccggactggccacttcaccaattggatattctttggcaaacaagcccggtcttaaagctgtcacctgtctgttataacccatagtgcgaaccccctggaaagttaaagtgccaagaacaaccccatcttgatccttgacaaggttccaatccatacgccttgggatagaggcacattggaagtatgatatagggaacatcctctccatattgggcaagaaaaggttgcggtctccaactttccacagccacttgtagtccccatcataagcaatgcctgcctcaaagtcaacaaaatccccgaagaggaatccatgtttgactatcggtttacggctcaggttctcaagtctagcgtccgtaaccaatatcctaagagtttcaggagaagcttgggtaattagttccacacggctcttctccgtaattcggaaaaccaggagttctcggcgcaggttgaatgtcatgttcagatccacaccaccttcatgcccaaaatgatggcgaaaagggagaggctcgctggtatgacgcactacaaaataaagaaagaagttagacaatgaaaaggtaatcagacgcggagatcgagtctcgcgtcgaaaatcttagatgcggagatcaagcctggcgtcaaaaatcttagacgcggagatcgagtctcgtgtcgaaaatcttagatgtggagatcgagcctcgcgtcgaaaatcttagacgcggagatcgaattccgtgtcaaaaatactaaacgacagagtccagcttcgcgttatcgaaacgagtcccctcgttgattcaaaaataggaactcatcgcggcgagtttaacgaccacaaaggtcatgctcaccaccgattagaggatatatatatatccaataaagttcgggatgaccaacttcagaacccctggtcacaccaggagttctatagaataaaatccctacctttagaggaaccaacttcagttgaatcaactccaacggttggtcctgtagtcgcaccaggagttttccccgataataaatcagagatatactgatggtcatcttctgatagattaagatcaaggttgtgttcattaagatcctcaacctcaacagcgtgaacggtctctccttcggccggttcattcattgtggcatctataggatataatgagtcataaacaacatatatacttatatgagtccacacaaatggaaatcagctttaccttcagtgaccgcgggggactcgacaactccactacttgcacccacttcctttagtttcactaaaaggagataaagtgtatagatcattagaagaggtacgcattctgacacactcatctctcgaaatttccctccgaatagagaaatacccgtacctacgcttagacctgatagattaatgtcaaaagttgtttgaaccccagcggggttgtcatccatcgcgtcgtgcatttgttgaacgaaactgggttccttagtttccataataccaggagaagcaatgtcagcctgaatctctccttcttcttgactccctgcggaaatcgagtatgggatgagttcaagtattaagaaatacgagaacagtaaaatgaaaagaaggatgaatcgttaccttgttcatctaaaggaacgttgtgggcagatgtctcctctaaggtaggacgaggaatacgtggtcgagatgcaaccttctttcttctttttaatgggtgcgcttccccttgaaactaagatctctcatgacgatacttggtgcgcaaactcggctgtcggaggatcttgagcctgagttaaaggtcgagatctatgtctctgagcgaggggcatcatatctttttcctcttcatctccactaaggacctccaccgtcattcgattgggagatgtcataacaaccctctcccttctcctttttggagcatttggtgattgagatgggtcagcataatgggtcctgtgagcaacgaaagggtttacatatcctctttcgaagaaagaggaagggagaccaacctctctctcttcatcaccagtgttaagctcggcatcccaagtctcatcttcagacctgatgttagcttttctttcttcctcagaggcttctgcttcgtcactttgaaattcttcttcgctgtcatccgaatgaattggtttcttgccttttcttgaagattcagcaggctcttttgctttttgcaaaagcatagtttcacgaacaacctctgtagcatgttgagatgcagcctccgcttctaattcggatatcttccttttcttagtaggagcgctagcagctattagccatctacaatataggaaggtcatcagtaggggaggctgttggcgtcaaaaaatgctaatagatatcccagacatagagaaaatcactcaaaggcaagaatgaactgtctcgccagcgagacaggctttgctgtctcgccagcgggacaggctttgctgtctcgccagcgggacaggctttgctgtctcgccagcgggacaggctttgctgtctcgccagcgggacaggctttgctgtctcgccagcgggacaggctttgctgtctcgccagcgggacaggctttgctgtctcgccagcgagacagtattgaaatggtcaaaactgcctttgtaactgcccgacacgtggccactaactgttcaagaacgtggagaacgtcgtgggcgagaatcacgtggataactgccaaaataacggagtttgaaacgtggaaaggcannnnnnnnnnnnnnnnnnnnnnnnnnnnnnnnnnnnnnnnnnnnnnnnnnnnnnnnnnnnnnnnnnnnnnnnnnnntcccggcacaggcaaagaacccacgaaagcagtgatccaaacaacgatcctacgtttgtttcccaagagttgtaattttcattttgttgtgtaaaagaagtcttataaaaagactatttcttttgaatttattgtaatcgaccgaagatataatgaattccatgacaaaacaaacttttggcgaaaacaaactggcgaccacagtgggagccaacggtctcgttgccgagaccgtcgtgtcgcagccaatcatcaagatcccgattgaatccatagtcgaatacgaattcgaccaaaccaagtttgaggaatatctctcatcgtcctcttcaagatcttcattgtctcgcaagtacaagaagatctcatcattgaagaagacgtctatgccaaagaaggcacagaatgaagactctcgcttgattgtcgctgaggattccactcgcaacctctctgctcataatggctcttcgccaagtaaagagtcattaaatcaaagcccaccggcattgacgaaaagagctcgtcaaagacaacgccaacgccgcgctcgccaaatggctaaggcgttagaacaaaccgacggggttcgttatcttgcggacctaaagttaaggaggcatcgagtggttcagttgtctcaacgaccaatcactcatgtctctgctaaactcacgacgaaggaatggactattgtcaaaaggactcgttcgaccctcaaagaacgtatacaaaaacgtcgtgcaaacgctgctcatgcccgtgctctcttacaacaaagacgagaagagaagaaggaaatggtggtcaaagaaacaccgaaactccgccaaatttggattccaaagtctgaagttgtaaaaaatcagcattcggagcccgttaagactccatacccacaagggggtggtgttaagcgtgcgactcccgacataaccttggatcgctcaaagacaaaaataaattgtcctgagaatgccaacaaggttttacacccccagaagaagacgcattcatcaaatgatatcgtcatacctgggaggtcatgccaacagacgatacgattttttggcaatcataccgatgaatcgtattatcaagttggggttgtgaataactttcgaaagagagttattcgggaaataaactcttgttgttcctgtgcgcgactcgttaaaacagcattatcagaatgtgactgttttaaacgagaagctatctcacgaagagtctttgtattgtcgaagcctaagccgagacatttccacaagagaaaatcaactgcccaagatgatgaattccctgaagtcaccatcaacgtggctgataaaagaaagtctaagcggcattcaaatgactcaaatcctgacttttctcccagaggaaaagtcaatccaagaattgctcaaaggatgtctcgactccaattaggagccatcagacgcagagattacaaaagaatgcaagaaggaatgtcctcggaggatgaattctcggacacttattctgcaatcgcttctgatgatacaatgtctagcacgggacagaccagagaagtacttacaatcacctctgatcagttcgctcaaatacttcaagaagctctagccaaacaacgtgaagaaattagagctgaagtgaagacagaaatggagttagccatccaacaaatgagagaattgctagctcaacggcttcaaccccctgcgtccagtcaaagaactgaatccatccgccacactcagaaagttgtggatgacagtgatccagaagtggatgaagtcattatggctgatacacctcccaatagcaataacgctgggggtggtttaacacattctcccaataacgatattgggagtggttcaatggcacctcttacagggggtggtctaactcattctcctcaacgtcattcgaataaagacatagacgatgacgggaaaatgaaagagcttgaaaacaaagtcaacgctttgatgacggctcaagaagtgaagaggacgggtattccatgtccctatccaagagaatggaattcaataccgtacccggcaaaattcaacatgattaacttcacaccgtttgacgggaagagttcgccgattcagcacttgatttatttcaagtctcatttgggcatgatctctggaaacgaggctttaatggtccggtcattcgttggcacccttcgcgggtcggccttcgattggtaccgacggctcaagccagggagcatcaattgctgggatgacatggaaagtttattcctcagcaatttctttgatgatgacaccgaagtgtcaatcggaacccttttggatgagaagcaaaaagacggagagtcagttgacaattttgtcaaacgtttccgtaacaacgacgacatccacaattcctgtgaacgcgactctcaatccgggattccaaaaggagtattctttcgaagatgacgaagctccagccatattggaataccttctcgccaatgacaaaatcgagctaccgcctattaaagatcaggagggttctaagatgattacagatccaaactactgtgcatatcacagaagggttcttcatcccaccaatatttgctttggactcaaaaataagatccaagcattaattgactccggcgtcataacggcgaaagaagtcgagtaaagacgaccataatactccattggatacacgagtataaactgttttccctgactccgataagtatacaagtataaactgcttctccacctcactccaaagagtatatgagtataaactgcttctcggtcatccaactaagtacaatgctaaacccagttttgtaaagaaagctgggggtggatgatttatgtaacgggaagttcctggagaatcgtatattcttaaggataacccgaacatacaactgatgataacatattctttgttatacccagttttgcaaagaaagctgggggtggataattcatgtaacgggaaattcccgaaagaatactatatgtaattttcttagggataacccgatcattacataacaaagtgataaacactatatccccacgatgatttttgaatactcttttgttaaggtgagattcgatcacttcgttggatcaatcttccctcacaaaattctctcatggtcaaacttttaaacggttaggtccaaagccaaaatctcctctcgattccttcaatgaacgagagggccacaaattgaacgattaaacctttaaacagttaggatcgtttcaaaactcccacttggtcaaaaccttactacagttaggaccacaaccaaaatcccctttcgattccttccaggaacgagaggtccacttttagttgaataatcaaaccttgtgacagttaagattattacagttaggattattcaaaccagtctaaactctctaagtggagatcccactttgagtttcttttgcatcaggagatagaatataaaattcttcctctccaattctgggtttatctctaccaacaaacaagagatcaggagatagaatataaaattcttcctctccatcatcgggtttatctctaccaacaaacaagagatcagaatactccaataggtatacgagtctaaactatttccctaatctcaacaggaagtttctggagaatatcacttttaaatttcctttgtaccaggagatagaatataaaattcttcctctccatcattgggttcatctctaccaacaaacaagagactaggagatagaatataaaattcttcctctccaggagtgggtttatctctaccaacaaaaaagagaccatattactccaataggtatacgagtctaaactgtttccctaccttcaacaggaagtttctagagaatatcaatcaaaatattcttaagaataacctgaatactccaataggtatacgagtctaaactgtttccctaccttcaacaggaagtttctagagaatatcaatcaaaatattcttaagaataacctgaatactccaaataggtataagagtctaaactgtttccctatcctcaacaggaagtttctggagaatatcagttaaaatattcttgagaataacctgactacccctaaacgggtatatgcagtgtcaacttgacgacaagagctgatttcacaagtacaagttccagctttaattcaagatctctacaatggacaagcgataaacgcgatgccgggaagaatcttaactattctacaaagcactgaatagattgagagacaaagagatcaaaagttgaagccacctacgggttcctctacacgatctactcaaccaagcattgaaaggatcgtaagtaagatctatcttatccaaagcatcccagaactcctctataaaagattgagtctggaatactttggagggggtatctgtaggcgtcaaaaaatgctgaaagatatccaaatacagctcaagaggaaatcatccaaaaaggcagaaaaaacacaagtcttgactgtctcgccgtgcgagacagacttgactgtctcgccgcgcgagacagtctttactgtctcgccgtgcgagacagtctttactgtctcgctctcgccagcgggacaggctttgctgtctcgccagcgggacaggctttgctgtctcgccagcgggacaggctttgctgtctcgccagcgagacagtattgaaatggtcaaaactgcctttgtaactgcccgacacgtggccactaactgttcaagaacgtggagaacgtcgtgggcgagaatcacgtggataactgccaaaataacgaagtttgaaacgtggaaaggcagttaaaatgagaaactgcattttccgagacagtatttactgtctcgctgggcgagacagcaaatttactgtctcgctgggcgagacagcaaacactgtctcggccagcgagacagcaaacactgtctcgagcctgttttccaccaactgttcatggaggttataaataccccccgaaggccatttttgagagggctgatcatttggagcacttcagagcagagagagcagagagcgagcagagttcctgagcttccggccactccttgatattcaggctttgacttgatttcaagaagaacgactatcttacttcgataagatatcgtttcaatttctaacttcgataacgaaggaagaatcagtaaacccctcttcacgatctgtgattcggtggtccacgagctaacgcgctcccggcacaggcaaagaacccacgaaagcagtgatccaaacaacgatcctgcgtttgtttcccaagagttgtaattttcattttgttgtgtaaaagaagtcttataaaaagactatttcttttgaatttattataatcgaccgaagatataatgaattccatgacaaaaccaacttttggcgaaaacagaggcattgacaatggcaggtcaaactgagcatttgtacatccaattatgctccagaattaagctcttgccccgtcgatcaaacccccacaaactctgaggtacttgttcggatttccaacatagagctaatcgtacccaaactggcgagcgaatctccaaggcaaatatggctcgatactgcagatatccttcactctgaaaaccaggtaaccaggacgaatattcattagccacctgaaacatgatactgcagatatccttcactctgaaaaccaggtaaccaggacgaatattcattagccacctgaaacatccgacatccaatacagacctgtcctgccttggcttttctatatccaataaagtgtcattgtaggtaccgaaaaattagggaaaacacaaacagaactcccaacaattatgaattctaaattgccgggacacgtcatgccattgtttcactacccacttggactcctccaaaatttgtagtaaggggagatctggattagcattttctggagatgacattagatccagttggtgaagaactaaccaagtcattaaataagtatacgacaattccattttgggaattggaatctctgtagaaggctgccttccctcttgtgtaaatgtagtagctaggtgacgaagcccactgtgaatgtcggctaccatagctgggagaagagacagcttacgacctgttgctagctgaattgctgaatataaaaccttgataggcattgcatcagaaggttggtgaggtactacacacttctttaaccaaatagctaaatacccgactaaaagagttgttggttcaatctgtgtgccggcttgccataaaaatgatctaaatctggtgccatgaggaaatccatcttctgaataggaagtatacatttgagcattcgttctctccaataatccattaatctccgatggggataaaggaggaaactcatacactactctgtcggaatgattctcaagattcttgaacatgtagtcagcaaactgttttaaactaagctgtggagacttcttcttggccttaccttccattgttgccatcacagtataatagtgacatgttaattcccataaggtgtcataagctattctagcccgctccttcatcctattcagttgaccaaccgtcgaaaagaattcctgatagggcacgtcaaccatgggtaatccagaagctttcatcatctcatagagagggagtcccaattctccattattggtaagaatatgttggtgtcggggttataaatttcaaatagagcaaagaaacgatcaacattaatttgtagaccatacatattagctcgaatgtggacgtataatccactttcattcaactcgtgctcccaacgtgttaatacgtagttggtcattctcgtccaccacttatctccagaataatggacccagcaataacacctaaacttattaatagggagctctcttcctaatcttgctaggcgacccttcacagtgttagccttagctaatatttcattttgagagacattgtcttagcctggaatacccgggtgaagccctcgtacggagttcttatcactcgaccatggagtcttagcatccttcccaagaaaaccgcaatggacagctcgtggtcctcggtcaacctcaaagacatctcacgacctacgactaaattcctaaaccgtaaaagagaatggtgacggggaattgatggaaaataccggaagtctgaaccatactcgttcagctattgtgtagggggacaagaaagggccttaggatccttcaccgaatctccaaagaggtactgtggcttcctcaacgattatgtcgaatccgggtcccatgtcaaaggagtgtctgtaatcaatcggcgtaaagtacggaggtctccgacgtccttcggacaatccgtagaaaattgaggtgcctcttcaattagaggaattccctcataacgagagtgcgtgacactactctgaccagtaacttctccatccgggaaggtttaagaaggaaaatagattgaaaataataattatacacacacacacacacacacacacatatatatatatatatgtatatatatacatatgtatatatatatatacatacatatctatatatatacgtacatacatatgtatgtatgtatgtaacatacatatatacttacatgcatatgtatatacatacatatatacatatatacatgcatgcatatatatacatacatacatacatacatacatacatatatgtgtacatatgtatatnnnnnnnnnnnnnnnnnnnnnnacgccgacgccgacgcctcccctgcagcgctccctcgacgccgacgtcgacgcctcctctcgaagaccctcctcctccctctctcgacgccgacgccgacgccccgtcgaagccgcttcatcctctctctctcgacgccgacgctggtaaaaaccctaacaatctctctcgatctctccctcgatccctatgtttggattgtgctaaaattagagatggatgaatttttttggtgatgattttttggagatggatatatatgttttgaactgagttatgatttagtttgcatcatgcagctctgcagtgatttcgtttgtttttaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggttattgtcgtatgatccgtgttttattttttctgctgttccattattgtcgtatgcttcctttttcagcttgtggttattgtcgttttattttctgtttacttacaaacaagaaaatgtatcaaatttgtgagagtttatttgaaatttggaagggcttgtttgtggctgttgtttatttgagtttatttgagaataatcaaatgctggccatgtctaacgagtttgcctgctgttgttgctgcttgtaatttgtgatattcattgttcttataatgttgttgctgctggacatgtacttgagaagtcaacgaagctcatttgtaatgttgtgtatggttctttcattgttcttgtaatgtttttgctgttggacatgtacttgagtttatttggaagggcttgtaatgttgttgctgctggacatgtacttgagaagtcaacgaagctcatttgtgatattcattgttcttgtacttgagaagaaaatacaggataacatgtacatctatagaatttgtgttgaaatgaaaattcactgccagctctgactctgatgcttccagtttccaccccctgatactctagaacttagtacagcactgcgccaatgcagcttaatagcttcaacttataataagcacaaatccaataacatcaaactgataacaaagagatattatagacaaagagctcatggtgcgatcttttgagctgttgatatcataagcctttgcccaagctttcatctgcagaaaatgcatgaaacgaaatcaaatggccaaaatatatgacagctgacttataaaccagttctttgatcaaatgcaggcacagttcaagaacttatcagctcataagcctttgcccaagctttcatcagcagaaaatgcatgaaacaaaatcaaatggccaaaatatatgacagctgacttataaaccagttctttgatcaaatgcaggcacagttcaaatgtagctaagattgcctgaatacatcagcacaaatgtagcaaatgataaacacatatgcagcacaaatgtatcgaccataatataatacatccaataactctcacaaattagagacattttcttgtttcaaaatagaaatagttacaacaaaactcattgttgatacattcagacttcatgcttggattttttcaaattgccacaattgctcgaaccacccacgtgcatgtgaaagctaaactgccacctgaaatgattcataaagtctggttacacaggagtagaaaataaataaaagataattagattgttctatgttatatgttgactcatgcatggaaccaattattatatgcttgaaagcgaaacagaaaatggaagcaatttaggaaatttaacaaagctaaattgctacaatatgcccctcttaataagttgtgatatctaagcggagggtaatgctatatattatctcggaaaactaaattgaacattaatgcggctaccatatgaccgtcgcaaaaggggaacaaattccgacatacttacatgaacaaatccatgcatgtggagctcaagaatccagacatattttcgtttagctgcaaatcacatgacaaattaatcatataattgtaccaaggaaaaattatgtattatgaactttcatgaaaaaaatataaacttcatggttctcaagttggtgcattccaattgcatctatagatttagttgcaagtacaaaacaggcctggactctataacatgtaggtttcagaaatcaaacactccagaggttgcatttatcattttggaggtaaaaaaattagtgcatcaccaaaaattattacatcaccaaaaatcactttaaatccctacaaacagatcttacacagtgtaagaaatagatgtaaacaagcaggctacaccctttatcggttgcatttatcaactagatagcataattaggatactcaactagatagcataagaaatagatcatgaactggctgtcactaataattccccaaagtaggattaatataatcaaacccgttcaaatccacaatcatcacttgctagaccatctcaaatagaatttcaacacaattaattcaacaacaaattcacagcaaagactcaattctcaaaaacaaagtcgacctcaaatgaaattttaaacccctgcaagcacacagataaacccaaaagaaactcctaacctcaaatgaaattttaaaaatagtaaacaaagtctataagcaagcagaaaccagttttatcaccgtcctcgtctatgtttgttgatttttttcttaattaactaggtcaatctagagagggattaagagggataagctaaaatttttcctgacagggatatcggggctggggttggcggctcgatctcacggttgttgatttgggaggaggacagggggaggggagatctcgcggcggcttggtcggctcgagagagggatcaagatggaactcacggcggcttggtcggctcgatctcgcggaagagatgagaaggagggaaggggggctggtggtggcgcacacagaacggggggctggaggctctcaaaaggcggcggctcagaggggactcgcggcggagaactcgctgcagatttgagagcggctcagaggggaatcaaagagggcttggagcggagatccctcgcggcggcttcgatttggggcgaggacggggggagcggatcttcggttttttcgtgctcagatttgagagagatttggggagaagatagagatttgatgagagagagagagaaggtcacggaggacacacacacacacacacacacacacacacacacacacatatatatatatatggttggaatctatttaaaagggatgtccaaaagctaaataaagggttgaactcatcttgtgagtccacgatatagagtcaccatcttacaataggcgaaacgacttcaattggtacaacatgaaaggcaacatacatcgccgagtatgaacactatggcaatatacatgacctttaatgtggaacaatataaaatcatccctactgcttttagatgcgttctgtccaagcaaaacaacatcttttagtgtcgatcctctcaaatgagaataccggctcttcccgactacctctcgaaggatagcaaacgaggatttacacacatgattcataaaatattggatttaaatcaacaaaagtggagaaaatgtaactctatgtgaagcgacaatgggctccaccctatcgacggcatgagagacggatctacccctcgggatacgagatctcttcggtgacatgatcaaagtcagatttttatcaaaaaatcctacaaaaaaggttagaattttggggttaaagcctgtcaaatcacagataatacccaaaatgcaactattgggttcgaattttacctaaaatcaaaggaagagaagaaccccgagagaagaaggctcagatctgagaaagagaggcaaaaccctagaatcccacgaatgaaatccacccaaattcgagcaaaagggaatgagaatgggttgaagaacacttggactaggatttaaagaggttttgaacttagaaggggcggaagaatgaggttgaaaagccccgagggtcgtgttttataacccactagaagctcctcgactgcccgcttccgagacagtcgtgactgtctcacatttccgagacattcacaactgtctcaaaagaagaagtaatccctacccttccaagacagttacgactgtctcggaagaagaagtaatccccacatttccgagacagttataactgtctcggaagaaggatcaacaccaaacatttccgagacacttacaactatcttggaagaagggatgacccaacacgtcgtcaatggcatttgtgaagcattctcgacccatttttggcatatttgaacactctgatgagtatatgagtataaaattcatctccttgaatctcctaatgggtacatggggttaaactggttcccgaaaactccaaggagtacacgagtataaactgattctccacactccaacgccttaagagcctaaactgtatagattccagttaacatatgggtataaactgtgtttctatcgcaatgaaggttgacaccagtaaaagcatcgataactatgccaagtcgaaggataattcatgggaattcatacataatttagatattaatttttgaacaagatgagtagttcatcgttgattcaatggcacaagctaaattcaacaatcaacacaagaacttcagttcaagatttcgacaacggttaagcgataaacgcaacaccgggaaaattttagctatccgacaaaaactaaatagactaaaatatggagaagttgacgaatcaaagtaggagtgtatcatatccaaagtattccagactcctctataaaaaattaaggctgaaacactttggagggggtgtctgtaggcgtcaaaaattacctatagatcatcgtatgtagctcaagacagagagaaggcgataaactacatcatctaagttgcaactatctcaaaaataggaagctgaccacgtttccgagacagttgtaactgtctcggaattgggaagctcatcatgcttccgagacaattacaactgtctcggaaatagaagttccccggtgtgacttattttcaactttcatcttcagttacagttcctaaagactataaataccccctaagaccattactgacgaggagccaagcagagagagcaaattgaacaaagaacatgagcattttggagcgttcttaacaagagagagagagtcttcataaaattcgagtgcaaacagtaactttgagattccttaagatctaagtttcgacttgatcttgagaagagtgttcatcttacatcgataagatattcacttaactttttcttacttttaaacgaagcaagaatccaaattatcttcacgattcaatcagaatctgtgaatcggtggtccacgggctaacgcacccctggcacaggcaaagatcccgcgcaagcagtgatccaaacaataatcttgcgtgtgtttttaaggagtttgtaatttaatttttgttgtaaagagtagttttacaaagcatgaagcttactcttctgtattcattataatcgataaatagttataatgaattctacaacagaacttgttcctgacgcaaacatggagctgcatcgatctccaccacctgcgatatttcctccgtcaggacgttctccacctgatgagagctaggaagtttcaagatagaagcctcattatagacattaaaaaatgccaaaattcaaaaggtgaaaagagaggtcagggaaacgaaccccttttcaatcagaaactaggttcattgtttagaaaagatcaacctcgagaacgagagtcgccatgcagcagaactcaacatcgaaagataaagttcattattgaatgaaacggatctacgagactcggagctcgtcattggatacgaggttcgaggttcgctagtgaatacgagacttgaagctcatcattggatacaaggttcgaagttcactagtggatacggggttcgaagctcgtcattggatacgagttagactctagctgtcagcgatgaatctcgtcattggattcgaggtttggagttcattattaaagatgaagttcgtcagtgaagacaaagctcacgaggctcgccaagcagcgaggctcgacatcaaagacgaggtttgctaacgcagtgaagttcgtcacccgcattaaatcaggctgtaacggtcataaagacccagtcagccacgtggactaaattcaaggagtcagttacgccacgacttcacaattttagcgcatcagttatgcccacgactctactattgtagcacgtcggttacgtgctcaaactcctataaatagccatcgatggctacagagaaaggggttggttgattactctgaattggataatttcaagtttagacttagagaagcatcagagtttaaagtttctacacgtcaatccgtagttcgaacctcgattccagccggttaacctacgtcagaagctcttacgatcttggtctgatcgtcaacggaaggtaagctcgactcaagcatcgggggaagcatcctttcgccacctagaacctacgttaaacaaaagaaaagttgaattaatcttctcttcatctgtaatcgagagagagcgtgagtgattgtaagggtttcgtaccaagtgatcgaacccatttcttaaaacaagaaaatcaatcccaacatcaattttttaaccctatagacaatggagaccacagtaggagcagctattctctccgacgagatggtggtggcacaatcagataagattgtagtgagaacaaacgttaaaactctggtcatcgaatttgaccagtccaaatacgaggagtacctctcctctggtaagtctagtcccacgaaggcacgaaagtgtcgtcgagtctcgtatgagacttcagcccaagtggcttctgatgattcaactcgagttatctcgaggaaaagtccaagcccctcaaagaggaggctctagtaattagccgtcagtctaagaaatgggttgtcaagcaacctagccgaacttcggcttctaccagccaaattacggctcttgataacgaaccacgcccagcttcggctgaggcaaaagtttctgttattccattgtcgagacgtgctcgacagcgtcagcgtcagaaccaagctcgctgtaggtctcaagctttggtctcgctagatgattttcattatagaccaaaggttaatcaacctaaggttaacaagtctgacgagggtcaggtgaatgaggaacgtccaaaagacggacctcatcctcataccctagtagactcagaacacgaacctcatcctcaaaaagaggttcaacataatcaacaagcggttcataccgaggttcatcaagaaaatgaaccttaaattaagaaccgactgagaagacgaactcaccaaactcgttctaataatgaacctcgtcatgcaaatgatggagtttgtcaacttacccaagactgtcaacctctatcatttagagggtctcgctcgggtaaaaccaagatgatggagtcgactgagggttgcccagctggcgacctttgggattatctcacgcgtaagcgcagcatgagccaaatgcaatcacattgctattgtgagaagctcatatctgtagtgctttcccaatgtccatgtggggagttgacacataaatcttcagtcttcgaatgattgactgaatttccaatggtctcatcatcaagaagaagacgcattcgtccaaagaaataagcatccaaggatcgccacattgaagtgacgatcaacatggccagcaagggtaaaagcaaaatctcagctgatgattcagagtcttctaattttgaaagatctctcggattacgagaggcacttagtgaaagccagagtgtttatcaacatactcgttcttgtactggggcaatgatcccattagactaccgcaaactagcgggtttatccagcggtgttggtgaagaacttgaaaattcagccattgttacttcccagccctccaacactgaccaaagtgagcaagcaagtgctcacatgacaggaagagaggaagaactttcatggtagctggaagatcaataatctaccatcctgaagcagcaggagtccatcagacgactggaagcgatggtggaaaaactccatgaggaaaagaagaagaagaagactcattcccaggcctcgggatctaggcgtagaaggccttcacctgttgatgaagatcactatgatgaagacgatgaagaaagagttgtgaagattcattctaaatcgtccaaagctgaacctaatcctcgtacaaaagaacgagatcagaagtgggaggattttcagaagcagcttaacgcactgaagcttcaaggaaacttcaaagagtcgggggtgtcgagaccctatccaagtgaatgggatgcgatcccgtatcctctgaaattcaaaccactcaacttggtgcaatttgttggcaagggttcttcgacccaacacatctattatttctaggcacagactggacacatagtggggaatgatcccattatgactcgactcttcattagtacccttaagggggtggctttcgaatggtttcgtaggctcgaaccagggtcaatccagagttggagagatttagagaggcttttcttagcccgattctttgacgatgacactgaagtgtctatggctacattattgtctgagaagcagaagaaaacggagtcggtcagtgacttcgttaagagatttagaaatcgatcattgtattcacatgatcaagtttccgaggctactcttgtggaaatgtgccgcaacaatctttccatcaatatcttatctaagatgggtgctgttgaagcccgttcatggaaggatttggtttggtagggagagcaagtggaaaacatgctcaagaggataaatgttgaagaacctcaagaatcccagcctaaaaagggaggtggtaaaggcaactataattcccagaaacaatcgaaggggaaagacaccttagctattgagacaactccatctccgaaatcctttaccaagcagaaagggaattcatccgataatcgttttcagaagaaatacgatttcaaagatgaacatgtggtctctgttctttcatctttaatcaagatgaataagatcaagctgccagaagtaaagcggagcgcagaagtattaaggactgatgatcctaacttttgcatgtaccacaggatggttgtcacgccccgcttcccaaaataccagggaatcgggacgtgaacaagcccgcgacgtattagattgagaagaaatatacactatcttttttttcctctttcttttcttctcaatccaatacgctaagcgtctagaaacaaatacaatacgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgaaaaacgatacgataatagaaacaacaaaagaacgtacaactgaaatccacaaatcaacatgaaaatactactaaatcatgataacataaagcatccaaaatcgatcaggtaacgaggtcatgcagctagcgattagtctaatcatccaagcaacaagatcatacaatagatgtaattaatacttaaaaatctacaactcgagacgtagtacgtcgagcgaaataatgcaaacaaggaaaccctcatgtatataccatatgtctcgaattgtaaataattaaatattaatcccgatctatgtataaaaagaaacacaactggactacctctcacaagaattcatacctagccaagaaacgaggtcatgtaattagccatcctataacaggtcactggttcacatctcacatagagtcaaggttcacattatcggatatctggttaacaaccacatctcactagtacctcaaagccgccccagtgcgaaacaattcactggtgcgtgcctgaaaataatcaataatcacaataccactgctcctcagacccaccccagagtgaaacgatccactgatgtgagcctggaaaatacataaacatccacatatcactactcctcagacccaccccagagtgaaacgatccactggtgcgagcctggaaaataacaacaaccacgatatcaatgttcctcagacccaccccagagtgaaacgatccactggtgcgagcctggaaaataaccatccacatccgaccacatgaaccaagaattcctcatcccaactcttctcgctttcctaagtcaacaatcataatccacactataactcgggttcaccacctaaactcagtcaacaacccacacatgtcactaagtctgttcatgacgcatgaggcccctaagtcatgaactactaatggttctcaaacacaacaagacgatattaataacattaatttcactcaaccacatcatgacatgtcgaatacagtaaaatattcacaaaacataaaatataatcatgtacagcaactacgtaattcagaaattaattcctttcccaaaataatttcttttaaaaattaattcttattataataatccaaaatattctcttccctagaataaattctttaaaattatttctcatcaattattattctagaataattctttttctcaaaataaattctttttaaatattataaatcctataaaatgatttcgtcatcaaaataaattattccaaaaatactatttattgcacgactatgatttaatcaatattattcagcaacaacccacgcagatatatagtcataatatactatgcaaataattcagatccgagcaagagagatcttgcctcggggttttcgtcgaatgaatcgatgttgacacgtgaagctacgacccaccgatgaggtgacggtgacagatctaaacggcgatgaggacagcaggcctgactggtggaagttcgacgatgctatgcggctggtcgggtcggcgtcgctgggctcggagttggcgtggagaagaggatcgccggcgtcactgcaggggaggggaggtcggggttggcgaggagctgctgtcggcggcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagctgagggatagagatgagagaggaggagagagggtgtacgggggagagaaaagaaagatttctttttttttatggaaggggagagaaaaaggaagtatgagagagagaattacggaagattttggggagtatatgatatgtttttttttgaattttgaaatgagagaaaaatggaaggatttatttttggctggagaaaaacatggggagtgatttaaggttgattggaaaattgattagggagattatggtaggaattcaaatgagagaaaattaaggggaaaaaagattatgggaaatatttatttattcacttattcataatatttaaaaataatccttataataacaattaaccatataataacattaataaataattaacagctaaatatttatatatttacatatgtactaatatactaagctcaggtttacattaataataacaaggtcactaataatattagctaccaaaagattatatataaaatctcattaaaccataaattaatatttagcagaattaaaaatacaagactatatattttattatttatttattttaaaaactcagaaaattccaaaaattaggaaaaatattaataaaatataatataacattttaaatactagaaaaattgtttaaatacgtatcgaaaaattacggttgttacaatggtgcatcatccaactaaagcttgctacatcctgaaagacaagattcaagctttattagacgcaggagtgatgacccttcaagctgagcaaaagaaggtgtctgcaaatatggtttcactttaatttgtagatttcaccgaagtacaaatacaagatggtgtacaaccaattcctcaagcggaggcgagggtggtgaatttcgacccgcatcggaagaaagagaagagaagagtcccttacactaccctaaaggcgaactgatgtgggttcatcctgatttgttaatggacaagaagtggacatcgacaaattcaaagaagcctagagccacacgaagatcttgcaatgctgttttagcccttccagatgagggggttgaaactacgtcacttagcagttctgaagatgaatagctagctttcactgcacagcctgcacaggtatcaggaacccgcgaaggaaaagagtatttgaagaaatattctgaaacggcagctgcaccacccagaccagggaaagaagtagcggagcaacctcaacctaaggaactttgttacaacaaagcactcagaaaagatgcaccggagagttcgaaagatccttttcggtttgatgtgctggctcagttagccaacatcccagcaaggattaccttgtttgagcttttacgtttatcccgatcaacgagagaagctctccgtgaagcattggcggataacgaagatttccttactcattttccaccaaatccagccggagcaacgctggaagaagcttgtcctcaatgttgtcactcattttccaccaaatccagccggagcaacgctggaagaagcttgtcctcaatgttgtcaagtttttcgaagaagaataccatgcatcaccttttctcaagaagacatgcatgtaaggaacccaaaacatgatagactattgtacttcacagggtacatcggctatattcgggtagatagaattcaggttgatcctggttctgctttgagcatcatccccttgcggttcattcatcaccttagaattcctctgcatcgtttatcaacgacgagaaccaccatatattacttcaatgcctctaatactcgtccccttggcaaaatcaaacttaaatgtcagatgggcgacttgaggatggatgttacctgctatgtcatcgatgcagagatatcttacaacttgttactgggtcgaccatggatccataacaatttgattgttccatccactctacaccaatgcatgaaatatgtaggtgagagtggtgaagtaaaaatagtggtcgcagagaagcaacctttcaagggggtagagaattattttactgattctatccaataccttgatggtgagccatttgaggtaccattgatcgaagaaccaaatagtggtaatgaagccgatatcgagtctgaacacgaacatggtcttgtttttaatgacacagaacccgttgtaatcggtcttgaagatctgaatgtaaatgatcctgtctatgaggatagtggaattatctttaataataatgatttagcttacttcttgtgtgtggaattgaatactaacatgctaggtacaaacactgatgtgatagcggatccgctatccaagttatatgctgaataaaatttatacataccgattcagtcgtcctttatgacaaatcgacgacagaccgaatcttcacaagcagtcttcatagtaccggctaaggctaacggtcaaaaagacatcatctttggaaagagtccggtgcaaaccattttggaggaatccgagaaagaggaaagagatccacaattctcatactttactccaagaacccgaaggctcatgaagaatataggttatgatttcattcataaacggggtttaaatttcggcagagggatccgaacaccaatacgatctgcgcatgtcccgaaaggaaagccagaagactattatcacaaaactcgtagtggattgggttacgaatctccaccgtttatgctgtgttttgggactaaaggagagtcagatgatgattctttcacctcgtcttccaaatccaattacttggaatctgatacaagtacatgagctatattcaaagtactcatggctaacatgacctcagtatctttgatagagaatcaggaagatgatcaattacttttgtttgatgatccattaagtcgacagcttggtatatagtgggaacatcgttttgaacaacacgaaccccctactgatgacaaggtgattcaggtgaacatgggagatgaggttaatccaaaacccatattcataagtgatagtttatcaccagaagagaaagaagatgttgttactctagtacgagaatatattgatgtcttcgcttggaactacgaggatatgcctgggcttgatccccaagtggctatgcattgactaaatatcaaaccagacgtcaaacttgttaaacagtagcagaggcgatttcggcccaaaatcatggaagcaattgaagctaaagtcaaaaaactcattgaatcaggatttatccgtgaagagcaacatcctgattgggtagccaacattgtccttatcctaaaaaaagaacgaaaagattcgagtgtgcatcgactttcgtgacttgaattcggcttgtcctaaagatgattttccattacctatcactgatgtcatcattgacaatacgtgtggatttgagaggatgtcctttatggatggattctcaggatacaaccaaattaaaatgtatcctaatgacgaaaagcatacatccttttgaacaccttcagggatatactgttatacagtaatgccctttgggttgaaaaatacgggcgctacctatcaacgcgctatgacctctatcttccaaaagcatctacgaaagactgtggaatgttacgttgatgacttggttgtcaaaagtcgtgacaagggaaaccatttacacgacttgaaaacaatgattgatcttatgcggatgcaccagctcaagatgaatccaactaagtcatttttaggaatggctagtggtaaatttctcgggttcatggtcacggttaacagaattagtttggacccagataaagtcaaggccatccaagagctaccacctcccaggaaccttaaggagcttcgaggcttacaaggacgattggtgtatattcggaggttcatttctaacttatccgggaaatgccaaccattctcgaaactaatgaagaaaggagtgtcctttacgtgggatgaggcttgtcagaaagcgttcgaggagattaagcaatatctctccaatccgccgatattagtcgcaccaaaggtaggtaaacctttcttaatatatattcgggctacagatcatgcattagcaggactcttggcacaagatgatgaaaatggtcatgaacaagccatctactatctgagtaggacattatcgggtgctgaaccccgttatcctctcattgagaaggaatgcttagcgctggtcttcaccgttcagaaaatgcaacattacttggttggacaaaccatacatgtcatttctcagattaatcctattcgggtattcatgacacaacccagtgtattgaactggcgactcgccaggtgggttttgttgctttcccaatatgacatccacttcaaacctcaaaaagcagtgaaaggtcaggctatttgtgaccttatggctaatcatcctctaaaagaaaaggccaaattataccaggacatacctgacaggacatacgaagcaaacgtcgtctctagagaacaagtatggcagttgtacttcgatggtgcagcaaggacaagttctactggtcgggttatagctggagtgggggttgtctttatctctccctaaaaccagatactcccatgtgccatttctttaacagagccgtattctaacaatgtggcagaatacaatgctttgttggttggcttagatatagccaaacaattgggggtgaaacacttggaagcatacagtgattctcaactcattgttaatcaaatgaagggagaatatgaggttaggaatgaagacctcgttccttaccataccgcagcaatcgtattatccgattcctttgaaggcttctacatcaaccatataccccgtctcaagaatacctatgctgatgcattggcatcacttgcggctaccctagctctaccggaaggaactacccagcaagtcacagtgacaagcaggcaattattcaaatcaaagtatgcactgcagatcaatgcagttgaagcagaaccttcaacattcaaacctaaagattggcgatttccgatcatcgattatgtcttatacggcttattgcctaaagacatcaaagaaaaagaatctattcgtagacgagcacctagattctactatgattctcaatcccagactttgtatcgaaagtcatacgatagacttttgcttcgctgtttgtcaaatagggaagcaaaagaagcccttaaaaaggctcatggtggcatctgcagagctcatcagcctgaacctaagttgtgggatcgactacgtagattgggttattattggcctaatatggtacaagatgttgttgtttatgccaaacgatgccacacctgtcagatacatgctaattacatgcatcgaccacccgtgcatcttcatccttcaaccacttcatggcctttcgaaacgtggggaatggacattattggtccagtgacaccaccctcttccaaaggacatcgtttcattttggcgataactaattacttttcttaatgggcggacgcaatcccgttgagagaagtcaaaatgagtgatgttgtttaattcttaaagcatcatatcgtatatagatacggcgttccgagacgtatcattcatgataatgggccccaattcattagccaagctttcacccgattctgtgataaattcaggatcaagaatttggcttcaacggcttataattctgccgctaatgggctagcagaagcatttaacaagaccatcgtcagaattcttactaaagtggtttcaacgaacaaaagagattggaatgagaaattgggtcagagtttatgggcttatcgcacaacggttcgaacatcgacaggagcgacaccatattccttggtatacggaggtgaagccgtattaccattagggatccaaattccttctttgcggatagcactcacaattggtatgacgacggaagagagtcatcgccaacgtcttgaagaattggaagcgctggatgaaaagcggttattggctcagcaacatattgagctttatcaagctcggatttccagagcatttgataagaaggttaaataccacacatttaaggaaggcgacttggttcttgcagctcggcacctgatgattttgaactccaagaagaaaggaaagtttgagccaaagtgggaagggccatttgtagtagaaactatctattcgaatggagcctatcgtcttatcactaaagatggcgacaaacttatgatgcatatcaacggtaaatttctgaagaaatattacccgtagacttcatcattaaatgtaccttgctacgagagaagaagcaaataaaggtaatgatttctttatttcatctcctccaaatttccctcattaatcctcttcaataggatagtgagactattatcgtgttaattctatctctgattgctgatggtcttctaatagtaacctactatgtgatgtgttgctttcctaacatcgtcattttcccaaatgacgttcgttttccaaacttaggcctaccaagtgatgtgccttcgtttccaacatcgtcatacttctaaagtcactaaacgatgtgattttcctaacgtcgttattttcccaaatgatgtttgttttccaaacttaggcctaccaagtgatgtgccttcgtctccaacatcgtcatacttctaaagtcacagaacgatgtgattttcctaacgtcgttattttcccaaatgacgtttgttttccaaacttatgcctaccaagtgatgtgccttcgtctccaacatcgtcatacttctaaagtcactgaacgatgtgattttcttaacatcatcgttttcccaaatgatcttcgttttcctaacttaggcctaccaagtgatgtgcctttgttttcttcgtcgttgctattctaagccattgaataacttgatcatcctaacgttgtcatttccccctaaatgacgttcgttttcccaacaagtctgccatgtgttgaactttgttcttaatacttagttatattttgaacctcgttatcacacatttgatctgaagtctaaaagagactaaagatagaagagaaatcttagcattaaagtctaagagaaactcttcgacaactcatcatactgaggggaaaagtatggctagtccaactcaaacggcagttggtaaagaccacccaagtccgttgacagctgagggtttgctaaaaatcctaagttagaatgcttcagttatgcaagagaacaatatgtggacaaaatataaattttattcatatataattgaagatacagaacttagaagactcgaactacaatacgaggttcagttacaagttctttcagctacaatacgaggttcagttacaagttctttcagctacactacgaagttcaattacaagttccacgaccttcgagattgcactacgaacctcgtccgtagcaaacgcgctgtcttgttgttgaagttccatcttctgttcctgggcatgaagtcttccccatacccaacatttaactttggtgcttgtagcacacgtttacctacttgggtaaactgactactaattaaaacaccacaagctctgagcataggatcagtacttctcccatctccgaagaacgtgaagatggcactaacattgttgctgactcctaaaagaagcacttcactgagcctgtgaagctgccacatagaccgaagtctagcaaagggactgcatgcttgggggtacatggcatgtcaaaacagcaagcatatttgaatttaagatatctcttccagattacattcaaaagtccaacaaggtgtccaaacatgtcctgattttaactctggaacactgagaaaccctcaaatgagtgagatactatgaagaccaagagatcagggatcgggtcaggagagttacctgaagcgacaaagtcatcaactttgcctacctcactggcgacgattatcggagcttggagtctaataggaagcaaaggtggaacttttgaaacggttcgttttctccgaattattttggaagcaaggtacagaagaggaagatgaatcatctcgaaaagcaactacctatttataggcacaggagccaaccaagtggctgggattcgttacacgaatccctaagcaccgaaccgctaaagggtgctgtgaacgaagcggcgcaatcaattgcgttcgtaattaacgccaaagaaaacatggctcaaaacgacgcatttaatactcaagacttaacgttgacgaaatgaaacaacggattcttgtggatcaacagtcttggaactgttaaaaaattgccacgtcgttcaacgagatttattctcgttcctaagtcaaaaataatgggggtcgctgtttcaaactgggcttaagtattgaaactcgattgaatttggattcgaatctcgtcttcgacgaaggtcgttcccttagttggactcaagtgttgagacttgattaaatttggattcgaacctcgtcttcgacgaaggtcgttcccttagttggactcaagtgttgagacttgattaaatttggattcgaacctcgtcttcgatgaagtttgttcccttagttggactcaagtgttggacttggttgaaaaagaatccgaacctcgtcttcgacgaaggtcatttcttgaattatactcaagtattagatccgaacctcgtcttcgacgaaggtcgttactttaattatactcaagtgttgaaatttgattgaacttggaatccaaacctcgtcttcgacgaaggtcgttcctctagctatattcgagtattgagatttgataaaaattggatccgaacctcatcttcgactaaggtcgttccttgaattttactcaaattttgagaactcgattgagatcggatttgaaccttgtcttccacgaaggtcattccgataattgagtgcaaacaccaaggattaattgaacgagattaggacctcgttgttagatcctagaggggggtgattagggtcttatgctaatctaatctgattttatgccaattaaaattaattaacaagttatcctagcaagtatgaaatacaacaatatatgagctaggataaaggcaatatgaacaatgaaatatatcctagcaaagagatatactatgagatatatatgtaaggatatgaaactaacacaagggtaaataatatgaaacaagatagtggatgatataaataatgagacaatggcgatatgagcaatgagcacaaatataaataaacgccaaagcacactcaaacacaatcaaatgatcacggagttcggaccttccgtcctacgtctccgctccccactcccggggagaaatccactaacacaatccggtttggaagccggaacttctacacactcggttttctagctaaccgaaaactcaacaactcactcttgcgaaccaactcaacaccctcacaagtgttggacctagccgtgtctccctcaagtgctcggttacaacctttccctaggttcgtcaaccgatgccactcctcttgggacgatccccgactctcaccacacactcctctcggtgtacaagtgtattacaaagtgatctatacaattaggcacaataacaaggtgtttgttctctaatacaaggtgagaacacaatgtaggctcacactcaatgtcacacaatcccataacccaattatataatgtatgcaaatacaataagctcaatggttgtgtgtgtaaacaaagagtaaatcaaatcaaactaaactcaaataaattctagcttaataaaatgataatcaaacaattatatataaatgtaaagctagattgagtttagaaacacttctctaaagatgacaagagagagggagaagagttgaatgcccaaacaccaaagaatgatctcctcaagctcttgtgaaagtttcttcataaacaaactcttgaaacaaacttaaaaactcttaaacaaacttgtaaaactctttttaaaactatcttaaacatccatgagaaacaatgaaagttgagggctttttatatcctcttaaatcagccataaactcccaaaaaccgaaaatatcaaaaactagccgttactagccgttataggctgaaaagaccaaaataccccaaattccagcattctggaaatttgcgtatctgacattgtaaaataaattaaaaatagtaaatcaattctaaaaatcatgaaatgttgtgtaaaggttctagacatgtatatgaacatgttagagaaagaatttatgaaaaataatttctcatttgagagaaataaatgtttgaacacagatatacagtttctgaaaatctgctgacatacacgattttgtaaaataaattgggcatagtaaatcaactccaaaaatagtaaaatttttaggaaagtttctaaacatgtagataaacatttaaaagaaagaatttcttaaatatcacttccagtaaatcaactctaaaaatagtaaaattttgaggaaagtttctaaacatgtagataaacatgtcaaagaaagaatttcttgaatatcacttcccatttatgaaaactcatctgttttgtaaaacatgtacgaacatgtgcacgaacaaaaacatgattttgtaaatttcattaaacataacaaatcaattccaaacttgatgaaactttgcaaaatgtttataaacatgaaaacaaacatgttacaaaaataaaattttcattttcatttctcaattgtgaaaactcattattttgtaaaaacatgcatgaatatgaatttgttaagaacttgtttttgacaaaaagagtttaaacgcatattgaaactttatgaaatgtcttcataaacattataacacatgaatataaagtaaacatggtcaataaaacaatatcacaaagttttcccaaaatagctcattttatgagaaaatccaatattgtgtgtgtatatgatattgagcttagagtattaaacacacataatataaacctatactaaatatacccaagcttgatgaaggtcttcaatgagcatgacttagtaaactatacggaagaagcttgtgattggatctttaacttgaattgacattgcttcactccacaattccgccaacctccatttgatatgatcgttaaggctcgattccacccattctccaacaacgttgtttgtctacaatacataggaaaatacaaatactagacaaacaacattagtggtaaattatttgttaaacatcatcaaaacaagaaggccaacaatctccccctttttgatgatgacaaacaatttacaaaaaggatatatgcatgaaaggaaatgaacatacaatgtataatatatcatgcatataaacaagaaagaatatactcacaatatttctccccctttgacaacatcaaaaaggggacaaaagaaataagagagcgaaagctccccctatcaataagcacgggtgagtatcaaacataaaaagatatagggattgctccccctatcaaaaagccatatagaatatatgcaatgaagatcatggcaaaacatatgtgagcaagcatacatgaatatgctaaaaatttactcacatacatgaagataatgagaacacacataaatatgtcaatatgaaattagtgtctcattaacacaaaaaaaatataaaaaccatataaaagaatagatttatgaaatcaaaagaagaggaacatgagaatcatgcaaaaagttttcaaatgaaaacaattcaaccaaaagaaatcataaatcaaagtttatattaaaaaacaatgtttgatcaataaagaaaaattttctttacataacttgatcaaaccactcatagaatacattataaagcacgaatagatgatccattagcacaaacacataaatatcatcatataagtgaattataatgaattcaaaagcaacaaatcaaaacacaatttttaagagaggcaacaattatatcaagctcttgagcttgttccaacccatataatcattttagcatccggtaaacttgatttgggaataaacacccaataaacccgaagggttatataaatacaaacctctcatcaaaacaaaacaaataatcatgaaaacaaaagattttatcaattataaattgttttcatataaaaagatttcaaagcataattttcaaaaccaagataaagaaggataaataagaatactaaaattcttggtttaaaatttaaatttgtacgagagattcaaaatgatcctataaacacaatgttcaaactcaaaaattgaaaacaagatgtactaactagaatgatgttatagaaaaataatcttgataaaatttgtatcaattcataaaggatgaaaacatgaaaatctatgaaagagaatcatgaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacgccactcctcttgggacgatccccgactctcaccacacacttctctcggtgtacaagtgtattacaaagtgatctcacaagataggctcaatacaaagtgattgttctctaaacaaggagagaactcaattaggctcaactcaatgttactatctctcacaaccccaaatatattatgaatgcaaatacaataagctcaagtgggtgtgtgtaacaatgagattaatcaaatctaaactcaatataaaactagctttaataagatgataatcaaacaaataaatataaagctagaaaagagtttagaaaacttctcaatagatgacaagagatggaggaagaatagttgattgctcaaactccaatagatgatctcctcaagctcttgtggaattttcttcacaaacaaactcttgaaacaaacttaaaaacccttcaacaaacttgtaaaactctttttaaaactatcttaaacatccatgagaaacaatgaaagttgagggctttttatagcctcttaaaccagccacaaacccccaaaaaccgaaaatatcaaaaactagccgttactagccgttataggctaaaaagaccaaaataccccaaattccagcattctggaaattctggaaatttacgtatctggttttgtaaaatcaattacaaatagtaaatcaacttcaaaaattattaaactttgagagaaggttttaaacatgtagaagaatatgttagagacagaatttctgaaaaataatttctcatttgagagaaataaatgtttgaacacagatatacagtttctaaaaatctgctgacatacacgattttgtaaaatcaattgggcacagtaaatcaactccaaaaatagtaaaatttttagggaagtttttaaacatgtagataaacatttaaaagaaagaatttcttaaatatcaaaacatgcacggacatgcacgaacgaaaaacatgattttgtaaattccattaaacataacaaatcaattccaaacttgatgaaactttgcgaaatgtttgtaaacatgaaaacaaacatgttagaaaaagaatttctcaaattgaatttccatttgtgaaaactcatgtattttgcaagtatgtccaaaacatgaaaacccaaaaccatgcatgtatatatataactatatatatacatagaaaccaaatacgtttgtgtatatgatattgagcttaaggtacttaacacacataatataaaacctaaactagattacccaagccgatcttgatcttcaataagcttgacttggtacactttgcggatgaagcttgaacttgatctttaacttgaattgtatgttgcttcactccataattccgccaacctccatttgatatgatcgttgaagctctattccatccatcctccaactacgttgtttgtctataataaataagaaaacacaaatactagacaaacaacattagtggtaaattatttgttaaacattatcaaaataagaaggccaacaatctccccctttttgatgatgacaaacaatttacaaaaagaaatatatgcatgaaggaaatgaatatataatttataattcacatgcatataaacaagaaagaatatactcacaatatttctcccccttcgacaacatcaaaaaggggacaaaaggatgaagagagcgaaagctccccctacaaataagcacgggtgagtataaaacaagtatagggattgctccccctatcaaaatgccttaatgaatatatgcaatgaatgctaaggcatacatatgtgagcaagcatagatggaaagtatgctaaacactcctcacatacaaaaagacaatgaagacacataaatatattattatgaagatagtgtctcattacactaatataaaaaccatgtataaaatagatttatgaaatcaaaagaaaaagagcatgagaatcatgcaaaatattttcaaatgaaaacaagtcaatcaaataaaatcataaatcacaagtaaatcatacaagaacataaaaccaaatcatacaaattctcttcgatctctttgaactccttaatccgttgcttagtctcaagcaattgatggttaagttcaaataaggagtcatccctttgccgcaaggtttgcatatcccgttcttcagccaaaggataaagagatcgagaccgatgattttcccattggttgaaaagatctttaaccttggtcaggtgaaaccaatacggtaatacagcaaggtcagaggttaaactcttcatcaagtcaaagaaaggcaccagcacctctttaacatctgcaaaatttcctccatggtccaaaacttgaacggaagattctctcaggatgctgaggaagttctctgatatttttgatacaacgaaagttctcgtcgaagatggaggagaagcatgtgtgctactagaggacaccgttgcatgagtagcggccaaagaaactctagctgctgtgaagactggcggcgcatggcatacggtaggagcgtcagcagttgtagcaaccattgtagtagtggtaggagcagctgcgactgcagtacttggtatgatgcaagtctcggtcgtcataatggaactggtagacacaacacttatatccatagtggcttcagcttcagctatggtggttggagctgattcatctccctcagcttcctcagggtcaacagtcggcttatcagctgggcctgattccatagctaaacttggaggtaccctacttttagcagggtcatcaaaagccggtctcacctcaatacctacatcggtaaaggtagtggaatatgtggaaacaactaagcgtgtcaaacaaagtcgttagtatcttagaaatccagaatggtaaatgactatacacctatcttaccaggatcagcaggagtgagtactcggcaccgaacgcagtccagagcggagtcgagctaaagaaatctcatcatcaagctccgaatccgtctcaacactgagtgactccatcaaaggagtcatgggcggagaaacattacgccttggtttttttggcgacacgtttagacttgcgcattcggccgatttccttagacttttcccccacttgtctggggcctcttcttccgcagtttgttctgaataagaagtatcagagggaaacaagtcaaaattaagactagtcaaagctggcataccggtaatcccttagtcgggatgtggttcttcaagaactggggattgtcgatgagagccttcagcagtagacccacgtggagcagactcgcaaggctcgtccatggaggcaaaatcctcaaatccaccaagatttgctccatcttttagagtgtctccaatatcggaagcagcaggcatgtggctcccgtactcgtcaacatgaggagatttatgagatacactctcatttagagccgcatctatctcttcttgagtctcttgagggctaggaggagtggtttcctctaccctaacactctcttcagcatgcaggaactctttaagccctggtatatggcttcacttagaagcattcctggatctgtatcagtgtcggatataatgcaaccccgatgaatttatgttgaagttgggaatcactgcgtttgccatgcaatgccacttgcaataagcaagtgttgtccgaagctgtggattttttggtggaagcaagaaacgagcacctgtgccgccggcaatggtctaatactaagctctggccccaatgattaagctacaaccctcagatatcagttgagtattaggattactaacgtacaactgggtgtagccgaattggcgagcgaagcgacaaagcaagtaaggctccaacacgcacactgggccgaagcgataaatatgatacccagggcgaatggtcataagccacatgaagaagccaagcgatagagaagaatagccctgaccattggatgcatccacaagggcctgtccgtaactggttccggggaaatgaggaaagcatcgattgaattcccatctcttgtggtcgcggagaatgcgcctcaccaaggccaagtaatggtgctcccaatcgattgaattcccatctcttgtggtcgcggagaatgcgcctcaccaaggccaagtaatggtgctcccaatctaaattctccaaccactgaatgaaaggaatgacttcacattctctacgagcagagggcgtacccataagggttggacaatgcagaacaacccatgccatgaaataagtgtagggcaaccctacctttgggttctcgttacctcgacaaaattggtaacataagctccgtaatccataatgaatgtgggcgatcatggcagggagaagggcataagaacgaccatgtgctaaacatacggcaatgaacaccacttccattggcaatgagtcaaaacttccagaaacaacgatgacttgatggagccatagcatgagatacccttccagcaaagccttggaagaaataggctctccaccttaaaagaaataactctcaaaagtggtaccgacagggtaaccttgttcatctgattccgacacccgatgcatgggaggataagtaagtacccatcgcgacaattcacttgcgtcacaaggacccaagggaaccacgaggtcatttttatgctccaagttcttgaagagatatcgagcccagatgctatggctgaggagtctctcacccttcttattgagccgtccttccatattcatacaaatgtggtaatgacacattaactcccataaggtctctactacttggggttgctccttttctagagcaactaactcccgttgacctaggatatactcctcatacggataattcccgtttggtagcccggagacttcttccatctcgtgaagagcaatccccatctctccatcaggagtaaagaaagtatgggttgtagggttatacaactccaaaataccaaagaactggtgggagttattgatcaacccgaattgtgtcgctctgatgggtgcataaagaccaaacttttgagaactggtgggagttattgatcaacccgaattgtgtcgctctgatgggtgcataaagaccaaacttttgtaggtcttcctggttctcctgcaaaatatattcagtgatacgaggccaccattgtgtaggactctaatgagaccagcctggagttctaaagtccttagcagggaattgaccgtttctcctaaaaaatgcacgaccaaaggtgttagcctcctcagcggtctcactaatcgagagttctttttaaaaaagcccagtgtgaaatccggtgatgtaacgaccaccactatctatctttgtgtcactacgagaaaagtggccacatatgaccccgtcttgtactggggttaaatcccagtccattctcctgggagccaagacaatcttcaaagcagtaagagaaatgtcacgctccatccgaggcaagaacaagtttcgtccgtttatagttctaagccattcatatgtcccgatatctagcaagtcaggatcctccgaagagtcttcgaacaagagaacaagcttcacaataggttcacaattgatagactctaagggagcatcaatgatcatacgcctaaatatggaaattgaagggtcagaaagaagatcctgaaggaccctagaggggggtgattagggtcaagaggctctaatatgcaattaaaaatcagtacaaacaaaccacagtaacagaagtgcaataataaagaaagagataaagttaggaatcgttatccttgacgcgcgatgtgttaacgaggttcggcccgctgacctacgtccccgctccccactctcgaggagaaatccactaacacatccggtttggaagccggaacttcgtctacacaatgatcccacaagatctctctctcactacacagttgatctcacagatcacactccttcacagtcgatctacacaagatctcactcacagcagcagaagataaatgcaagacactctctttacacaagcccctatagcaaagagaagagtactgaagctgggaagtgaaacacacacaagaactcagaagaacaagtttgatttgaaaattttctcaggaagaaacagagctctctggttctctttcaaacgttagggcttagggaagaagaagcaggcttgggggtttttataaaagagtttaaatcaataaaaacaaaaacccaatcttcctatttaggaagataatctactttgcaggttgtgacctcagactgtgccaatcactaataagtgaaagcacaggagtcgaggcgaaaaacgaccgttttaaaaaatcgcggctgaccaaatcggttgaccgaagaaataatcggtcgaccgaaaataccgtcggtcgaccgaccgaaaaattcggtcgaccgctgacagctaaagaaatttggaaaaacaagcagagcctcgtcggtcgaccggcacggtcgaccgattagaagattgaaaattcgaatagtattttgtgaaaaacgcttaaaagcacaagtttaaaaacgtgtgtgtgattcccaatagcttcaagtaaactcagtaactctttgcctacattctagcactagagagaagaacaaaagaaggctaatatcctcatattgaaagcaatacttgagctttgatatagcttgaatcggatgaagcttttatatgactttgttgttcttgaaataacgttgcttcatctttttggcctcctcctcctttagatgtcttcgttttagcgtatattccatccatcctccgttaatggcactaacgagcttgacaaatgattttactacatttacactcaataagccattagtaccgataatggtggttgtaagaacatcatcaaaacataagggctaacaatctccccctttttgatgatgacaaccaaccattatataagagcaaaaataagatagcttatagataggtgctccccctatctatgagctccccctaaatatatgcaacaaatgaggagatttctctccccctttgtcaccatcaaaaatggggtaaagagaaatgccaaatgcaaaatgcaactaatcaagcaagcaatgtagaactttcacatagtgcataagcccaaaccatttcttatgcgacaaaaatcatcctctccaagaggcttagtaaatatatccgctagttgagatttggtgtcaacaaatactagggatacatcttgtctctctacatgatcgcgtaagaaatgatggcgcacgtcaatatgcttagttctagaatgcaaaaccgaatttttggaaatatttatggcacttgtgttatcacaaaagattttaatattttgaaaattcaaatcatagtcaactaaactttgtttcatccataaaacttgagcacaacataagccggcggcaatgtattccgcttccgtagtggacaatgcaacacaattttgtttcttggaagcccaagaaacaagggaatttcctaagaattggcatgttccactagtactcttgcgatctaccttacatccggcaaagtcggcatcacaaaaaccatataaatcaaaagtggtgctttttggataaaacaaaccaaggttaaaagttccattaacatacttaatgatccttttaaccgcaattaaatgagatgcttttggagaagcttgaaaacgtgcacatgcacatacactaaacatgatgtcgggtctactagcggtgagataaagaagactacctatcatacctcggtatagtttttggtccacatcttcaccactctcatccgcatcaagcttaacactagtactcatgggagtaggcgcatgcttagaattctccaacttaaatttcttcaccaattccttcgcatacttgctttgtgaaatgaagatcccatccttagtttgcttgacttggagcccgagaaagaatgtaagctctcccatcatactcatctcaaagtgatcctgcataactttagaaaattccttgcacaaggattcattagtagcaccaaaaataatgtcatccacatatatttgaaccaaaatgaaatcatttttcctttttctcacaaaaagtgtgttatcaattgttccttttgaaaaaccattttcaataagaaaactagagaggcgagcataccaagccctaggagcttgtttcaacccatataaagctttttgtacccggtaaacatgattaggaaaagcatgatctataaaaccggggggttgctcaacatacacttcctcttctataaaaccatttaagaaagcacttttgacatccatttgaaatagtttgaaatttttaaaactagcaaatgccaaaaacatcctaatagattccaaccttgcaaccggtgcaaaggtttcatcatagtctatgccctcctcttgattgtatccttgggcaaccaaacgtgctttatttctagttacaatgccatgttcatcaagtttgtttctaaaaacccattttgtaccaataacactagcattgttaggtctaggaactaacttccaaacttcatttctttgaaaattgtttaattcttcatgcatagccaaaacccaaaactcatcatttaaagcatcattaacctttttaggttctagttgagatagaaatgcaacattaccacattcactcaaggcttttgagcgagttataactccttttgaagggctcccaatgatttgttcctttgggtggtttgatgtgaatttccaagctttaggttgttcaacttgatcttgagcatttgtgcaatctacatccttttgagcttctatagagggagtgtcattgatttgcaacaagtccaatcctccctcaatatcatcatcatcatccttcctaggcaaaacaacttgagagccaacattagtctcatcaaaagtaacgtttatagactcttcaacaacgaggcttcgtttattgaagaccctataagccttacttcgaggtgcataacccaagaaaataccaacatcaattttggaatcaaatttatcatggtgatcttttgtatttaaaataaagcatttgcaaccaaagacacgaaaataaccaatgaaatgagtttttccataataaagttcataaggggttttcttaagctttggtctaatcaaaacacgatttaaaacatggcaagccgtgttgacggcttccgcccaaaaatattttggcaaatcaaaagaattaagcatagtgcgtgccatctcttgtatggtgcgatttttccgttcaacaacaccattttgttgtggtgttctaggagcggaaaacatatgagtaataccatgatgagcacaaaaatcatagaaaaattcattttgaaattcaccaccatgatcacttcttattttaacaactttcaaatctttttcattttcaatccttttaacatgattagcaaattcttcaaaacaatcatttttcttagcaagaaatattgtccatgtaaaacgagaaaaatcatcaataatcacaaaaacatagtgtttgcctccaagagaggtaacacgcataggaccaaataaatcaagatgaagtaattgcaagggtttagaagtcgatacctcatggatggatttgaaagaagattttgtttgtttacctttggcacaatcctcacaaattgtatcttttatgaagtgcaagttaggtagccctttcacaagattcttcttagacaattttgagattagctccatatttgcatgtccaagtctcttgtgccaaatccaaggattttcatcaattgccgcaagacactttacatcttgattcactaactcattcatctcaaaaatgtaaacattagacttgcgatttgcaatgaaaacaatttttccatccatactaatgatgcatttgtccggtttaaaagaaatatcaaaacctttatcactcaattgactaatactaagaagattatgatttaaaccacttactaaataaacatcttctattatgggtgagggtttcttaccaatggagccaataccaacgattttgcctttctcacctccaccgaaggagacattgcctccttcaatccttgatagggttgcaaataactctttgttgcccgtcatatgatgtgagcaaccactatcaaggtaccacatctccttacgtcgttgccgcgacgttccctacaaaagaagaagatgaaggtgtagtagctttaggtacccatgtcttgggtccttggtggttagtagtcttggtacctttgggtacccatatcaaaccataaaaatcttcattgtctttgattctacaatgagtagaaatatgtccatgtctcatacaatatgtgcacacaaaatttcttttgtatgcatgagagtgagagccataaaacttatttctaccatgatgataattagcaaaaacatgagtgggtctagtcctacaaccctcaatttctaatttttcaatctttgatcttagttgcttattctcgaaatcgagatctcctagcaattcatctttaagagcaagagaggttgttagttgttctagcttaatatcacaagaggcatgtaattttttgaaagaagagtattccttagacattcttttaaattcaaaattcaactcttctaaagccatagctatatcacattgcatatagaaagattcactttcggcctcggatattacctcatgttcatttgccatgaaacaaacatttgggtcatgaagagccaattttgctccttcttcatcactctccgagtcacttggttcggattcttcccatccggcatacatagccttcttcttcttgtacttcatgtacttttctttgagcttggggcaatccttagcgatgtgacccggttcattgcattcaaaacatttaactacacgagatgaaaacttgttgttagatcggggattaaattttttgttcattttaataagtctagagattcttctagagagatgagccacttctctagaaaaatcaacttcactatccgacgacgaagatgagttgtcactagctcctttgagagctatggtcttcaactttggtgacggctcctcaacttcacgtgatggcacttcctccttctccttcccttttagcttcttctcatgcaccttgagctttccgataaggctatcaagagctaaggtagtaaggtcatgagcttcctcaatggccgtagctttgggctcccatgccggagttaaggagcgaagtatcttgtagttcatctcttgaatggatagttgcttatctagaccatgtaattcattgatgatattagtaaaacgagaaaacatagcatcaatggattcatttggaagcattttaaatagctcataatcatgcataagcccactaattttagattccttaacttggggggttccttcatgtgtgacacataattttacccaaatttcgtatgcggttgcacacgtggaaactctattatattcattaggggaaagaccacaaattaaggcgttcatagccttagcgttgagattagctaggtgcctttctccatcggtcatgttcccgactttggacttttcctcatatttctcttctatgagctctagaatgtcaaggtctatgcaacgaaggtaaattctcattctagccttccaataggcgaaatttgtcccggtaaagagaggtggtctagttgtggattgtccttctaacatatgcatattcaaagaggcctccattagatcttttctctaaggttgttaaaccaaaaactgatatagagaccaagctctgataccaattgaaggaccctagagggggggtgattagggtcaagaggctctaatatgcaattaaaaaacagtacaaacaaaccacagtaacagaagtgcaataataaagaaagagataaagttaggaatcgttatccttgacgcgcgatgtgttaacgaggttcggcccgctgacctacgtccccgctccccactctcgaggagaaatccactaacacatccggtttggaagccggaacttcgtctacacaatgatcccacaagatctctctctcactgcacagttgatctcacagatcacactccctcacagtcgatctacacaagatctcactcacagcagcagaagataaatgcaagacactctctttacacaagcccctatagcaaagagaagagtactgaagctgggaagtgaaacacacacaagaactcagaagaacaagtttgatttgaaaattttctcaggaagaaacagagctctctggttctctttcaaacgttaggcttagagaagaagaagcaggcttgggggtttttataaaagagtttaaatcaataaaaacaaaaacccaatcttcctatttaggaagataatctactttgcaggttgtgacctcagactgtgccaatcactaataagtgaaagcacaggagtcgaggcgaaaaacgaccgttttaaaaaatcgcggctgaccaaatcggttgaccgaagaaataatcggtcgaccgaaaataccgtcggtcgaccgaccgaaaaattcggtcgaccgctgacagctaaagaaatttggaaaaccaagcagagcctcttcggtcgaccggaacggtcgaccgatttgaagattgaaaattcggtcgaccgtatcggtcgaccgacgacaatctggaaagatactaagggatggccataggatcggtcgaccgatttctgatattttccagaaaacaggtttttgaccaacttgaaatatttgcaagatattcatttgacctctgaaaattctgaaactttgtaaaatgtttttaatactaaaaacaaactgtttggaaaaagaattttgcagataggtactcatacttgtgaaaaatagtgttttgtgaaaaaacgcttaaaagacacaagtctaaaaacgtgtgtgtgattcccaatagcttcaagtaaactcagtaactctttgcctacattctagcactagagagaagaacaaaagaaggctaatatcctcatattgaaagcaatacttgagctttgatatagcttgaatcggatgaagcttttatatgcctttgttgttcttgaaataacgttgcttcatctttttggcctcctcctcctttagatgtcttcgttttagcgtatattccatccatcctccgttaatggcactaacgagcttgacaaatgattttactacatttacactcaataagccattagtaccgataatggtggttgtaagaacatcatcaaaacatgagggctaacagatccacttcttctagcccccgttctccgaacaaaggaatgctctcaagggcatagtaacaaggatgaattgcgtatgtttgagtaccatccgctccgagatcgccacgctgaggaagtggagtagaaggatatatgactgcacaaaaagacaaacaagattagtctcaagcagcagttacggcctaataatacgaaggtcattctggcaacgaacgtcgaaattcattcgaatgatgaacctcgtgttacaacgaagtgttaaacttcattggccaagcaagctcattcaacctcgacaaggataacgaggttcaccagttcaacgagattcgttggagaacacgaagttcattatttgaaaacgaagttaaccagcccaacgagcgtggtcgacgaaaagacgaacctcatcatataaacgaatttcatttaacaattctagaggatgtagaaccccgtaaatttattaatgaatatattgagttattagtggtaaacatttcttttgagatgaataactatatatatgttaaataaatgtgataaatagtgtttgggagcctagcaagaatttctatgttagagaaatcaaggggattgatcagcatgtgatagaaggcatagcaggcagttgttctgctgtgcggtcgaccgcgatgtgcgcggcggtcgaccgcacagcagtcgggcacacaggagacttttctcctgctgtgcggtcgaccgcgcaaggcgcggcgatcgaccgcacagcaggcaaagagtttttctgtgttgggtcttaatgggtttcgagtcgggttcgggtcgggttgtggggttagtatatatactatcataccctaaagagccccatttctcatctgaaatcagaaccctagccccctctctccccctcaaaccctagttctcacttcttggtgatttgggagaagccttgaagggatttccagcgaactcttggtggattcagcgtgggggatcatcttccttcagatctagggcttcgttttcatcataggcgagtaacatctcgcccaacttcacccctctttgttttatgcttagatttgagtttttaatccggtttttattaagcccaaatcgtattttgtgtagataaagtagatcttatggcatgaggtgcaaaaatcatatttttcagtcttaaaaagttcactaatgatgtttaattaatgagatcttgatctgaaacgtttttatgaaggttaaacttattttcttctgtttaagaacttttaaaatcatgttgattaagatttgggatttttggtaatgaggttttaactatttaaacttgttatttactgccacacattactattgaattgttaaaacttgttggttataggaaacctcaaattttgaatgagtttcggagctgacagaaacccaggctggggttctgtccgatcagcggtcgaccgcatcgaactcagcggtcgaccgtcgcgagtttttgccagcagaatcgcttctgcactttgagcggtcgaccgacatgaccactgcggtcgaccgccgctcagcttttgagcccagtttttctcggacctgcgagcggtcgaccggggcgggctctgcggtcgaccgccgcacagattattttgtcctgtttatttttgttgaaccttacacttgttcgagtgcttgccttgatcatataactttggttctcagttttattaagtatctgtgcatgatagatggcttgaaatgccagattagaatcacacaccgagttgagtgtgaaatttgtataagtacatctcctcatacatctcattgacgattactatttggcccatgtggtgggaaaactaggttaaattcagtcctcgtgttggacaagcacccccccttagtcctcgtgttggacatacctcttagtcctcgtgttggatatgcattaccacccggtccaggcgttggacaacggtcacatccgatccaggcgttggacaacggtcacatccggtccaggcgttggacaacggtcacttccgggccatgcgctggacaacggttatactcagtccatgagttggacgtttatttcatgtagtctatgttctggacacttaatcgttttctgacacgtcacccatgtgagtatgatatgacacttatgtagaatacgacatggtattcatgtaggtcattacctaatactgtatttatgtctgagatgggttgtatttctttttttttacttgttttctgttcccgtattagactctgggtttggtacttagggattttcaatttgagatacaaggtatatacatgagggtttccttgtttggattatttcgctcgacgtacctatgctcgtgttgaaatttcctaagtactaagaccccctttgcttcagggaatttgtttatacatatacattttgtgataactgtattttcttatacaacgagccctctccattggggttggttgtgatgttgctcgctagcgctttgacgctcattgtccctccccctttcaggtcacgagccaggagcccggagagtcgcaggttgatggcgacacactttagtgttcagctatcttttctagctatgctttatgttggagctccactgtagtatttgttagacatttgaggactatgttataattgttgtaaaggctgtatgccttatttcctttactcagacttattgtatttgaggcttgttgaaaactccagtttgttcattttagactttgactttgtacttcggtatgttggatgataaaatgttattatgatctctaccatttcatcagctattctctgtattatcttttacttgcttttgtatcaacacctgttattgactctactagagtgatagaattgtgatggtgaaacatgttaatgtacggtgtggtgcatggcaggtttgacattcttggtttcaccgaggactgcagccttgtgtgaaccaaggggcgtcacacaaacatcatgatcccttaggatcatcctgtgtcgagtcgtagagctaggatagagtttcttaggattcatgtatagagtccgataagaatttcctagtatgagtgaggacgatatatgcgtatatctcaaaattttgagaatttttttttatgacagctatttttgtttaaagtattggtgtgaatatgaatataatatgttgtgaaagtcgtatggtgatacattaggtatgtacatatatctattttggctcatgaactctttttgttatatgctcagatgtcggaatatggtatgccacgtacccggagacctggacgggctgaaccacaacaaacttcacccgaaccacatcagacgctacctgagccgcagcaggctccccagtatctgatagatcttatggctcccttagttgctagggtagcagcaatcgaggagcttgtggcgaatcatattacaccaccaccatcagtagctgaaaccgccatttttcaagaaaacgggacggctaagtttcaggaggataaggaaggaagtgctaagagagggcatactggagacaagggtaagaacaagagacccttgtctagacctctacagcagcagcagggccctcataaaaagggatcccaacaggatcagagagcacaacatcagcccaagttcaggggaacttgttttaactgtcgcaaggtcggacacaaggcattagagtgccgcagtgcaccaacaagagctcagaagagaaatggtccgaatcagcagcagcagaagattgaggggtgtgttctagcagttcaggaggttccccaggggcagatcgtcccatattctccaacaccagcagcagagctgtttttattcaccggcaaagtatatgcagtagttccgcatgataatggagcaaacaaatcagttatggagggtacgtccctcataaatccttttccccgctcgtattcttttcgattcgggagcttcgtgttctttcatttcgtatgcttttatgactagactccaaatcgtagctcagcccctagacattccattatcggttttccatccctttaggtggggtatcgcttctggagagcatttgtaggatgtgtattattagtctaggtgagtcggagtttgttatagatttgatagtgttgcatgtgtccgagtttaatgttatccttgttatggattggttgttatcctgccatattaattctgactatcttcacgaagatagccagattgtgagcatccaatgggtccgagatgattgtggccacttctcagggcaatcgctttgcggagtctctcctggcaatcatcgatgaggagatgtgacgggatcagagttctgatttgttggagactagagttgtctcagattatcaggatgtctttcaggatatacctgggttacctcctgtgtgagaggttgagatttacattgagttgcagccgagcaccgccccgatatcccgcgcaccctatcgcatgacactagctgagatgagagagcttcagacccagttggacgagttgttagcttagagttttatttgttggagtctttctccgtggagagcaccggccctcttcgtgaagaagaaggacggcagtataagatggtgtatagattatcggtattgaacaagatcactatcctgaataggtaatcattacctaggattgatgacttgttcgactagttgcagagagcgcagtatttttcgaagattgatcttcgttctggctatcatcagctgtgggtttgggagatggatgttcccaagaccgcatttcttactcgatatgggtccttcgagttcttggtcatgccatttgggttgaccaatgcacccgcggcattcatggatttgatgaaccgggtttttcatcctttttagatcagtttgtgatcattttcattgatgatattcttctctactcgagatcagaggcagagcatgaggggcatctacgggtagctttgaggactcttcaggagcatcagttatatgccaagttcagtaagtgtgaattttggctttcagaagtcagattcctcggccacgtcatcagtagagagggcatagctgttgatccagctaagatttcagcagttcttgattgggagccgccgaagacggtgaccgagattcgttgcttttttttgggtctagcgggctactacaggaagttcgtccaggacttctcagagatttcggcgccgattacacgccttacgaagaagggtgtacagttcatttggagtgaggagtgtcagaaggcctttgatacattgaaggctaagttgactacatcaccggttttgactattccgatcagcgacaggacattcgtcgtatatacagatgcatcgttggcaggtttagggggcgtgttgatgcagactcagagagtggtagcttatatctcacggaagttgagggtgcatgagcagaactatcccactcatgatttggagttggcagcggtggtgtttgcactgaagtcatggaggcactacttatatggagtgcagtttgagttattcacagaccatcagagtctgaagtactttttttttctcagaaggaactcaatcagagacagaagagatggattgagtttattaaggactacgagttcgcgattcagtatcatccggggaaggcgaacgtcgtagcagatgctttgagtaggaagcgtcgacatcaggttgcggctttgaggtgttcattgtacagagatctccttactcttagccagtttgattttagacccgagatttggaggaaccagtgcatttttgggagctatatcagtgcagccatcttggagtgactgagttgtcagagctcagttgggagattcttggatccaaatccgaaaggaggagatttccaaggagcctaaggctgattggaccattggagcagatagaggtctacggatgaagagtagattggttatgccagccagtgcagagctgaagagggagttacttgatgaggcacaccgtactcgatacacagtgcatccagggaccaccaagatgtacaaggacttgaagagacatttttggtggagcggtatgcgtagagagatagcagactatgtggctagatgttttacctgtcagcaggtgaaggcagagcatcagagaccagcagggacacttcagcctttgcctattccggagtggaagtgggcggatatttctgtggattttattgtggggttaccgaagtcgaagaaggggaatgattctgtttcggtgatagtggagcggttgacgaagtcagcacattttattccagtgaggaccacttatacagctgaggcttatgcgaggatcttcattcgggagatagttcggcttcacggagttccgaacacgatcgtgtcggatcgaggatcggttttttttacttcacatttttggaggagtttccaggactcatttggcagcaggttatcttatagcagtgtattccaccccagacggatggtcagacggagagggtgaatcatgtattggaggacatgttgcgggcatgtgtcattgacttccaaggcagctgggaggatcacattccattggtagaattcgcttataacaacagttatcaggcgactgtcggtatggctccgtatgaggcattgtacgggaggctctgtagatcaccgatatgctgggcagagccgtaggatagtttgatgcttgggccagagcttgtgagacagactactgagaaggtagcattgatcagagagcagattctagccgctcaaagtcagcagaagagctatgcagataagaggcgaagaccactagagtttcagattgatgatttggttatgctgaaggtatcgcctatgaagggcgtgcagcgattcgggaggcaagggaagcttgcaccgagatatattgaacctttccggattttagagcgcattggagctgtgtcatacagactagatcttccaacatcgatgtctagtatacacaatgtattccatatctctatgctcaagaagcacttgcacgatgaggagcagcagcgagtgttggatgcaccggaggttgagcttcgggatgatttgactactattgagatcccggtgtctatacttgctagagaagataagagactcaggaacaaggtgatcccattggtgaaagttcaatggaaccgaagtggatgtgaggaagcttctcgggagcgcgaggaggacatgcggcgtgactacccacacttatttgagcaggtaaataaatttcttatgtcataaaccttatgttatgtttatatctttggttatgtttatatttaacactagaatgagaatatctttgcttaattcttaatcttttggaacacatggtatatatatggggggttccttgtttggatttttcacccgatgtactagttccattagattagggcttgagcgagaatattatcattttggacggttaagtataaatatccatgtgcgctcatctagaatttcatatttcgagatgagtatgatttccgaatttcgaggacgaaattcttttaaggggggaagaatgtagaaccccgtaaatttattaatgaatatattgagttattagtggtaaacatttcttttgagatgaataaccatatatatattaaatgtgataaatagtgtttgggagcctagcaagaatttctatgttagagaaatcaaggggattgatcagcatgtgatagaaggcatagcaggcagttgttctgctgtgcggtcgaccgcgatgtgcgcggcggtcgaccgcacagcagtcgggcacacaggagacttttctcctgctgtacggtcgaccgcgtaaggagcggcggtcgaccgcacagcaggcagagagtttttctgtgttgggtcttaatgggtttcgggtcgggttcgggtcgggttgtggggttagtatatatactatcataccctaaagagccccattttctcatctgaatcagaaccctagccccctctctccccctcaaaccctagttcgcacttcttggtgatttgggagaagccttgaagggatttccagcgaactcttggtggattcagcgtggggggccatcttccttcagatctagggcgttgttttcatcagaggcgagtaacatctcgcccaacttcatcccatttcgtttttatgcttagatttgagtttttatccggttttattgagcccaaaatcgtatttttgtagataaagtaggccttatggcatgaggtgcaagaatcatatttttcagtcttaaaaggttcactaatgatgtttaataaatgagattttgaactgaaatgcttttagaagagttaaactcatttttactgtttgccagcagaatcgcttctgcactttgagcggtcgaccggcatgaccccagcggtcgaccgccgcccagcttttgagcccagtacttctcggacctgcgagcggtcgatcggagtaggctatgcgatcgacctccgcacagattattatgccctgtttgtttttgttgaactttccactcgttcgagtgtttgtctcgactttctaactttggttctcagtctactaagtatctatgcatgatagatggcttaaaatgccagtttagaatcacacaccgagttgagtgtgaaatttgtataagtacatctcctcatacatctcatcgacgattactatttggcccatgtggtgggaaaaactaggttaaactcagtcctcgtgttggacaagcactaccccttttgtcctcgtgttggacatacctcttagtcctcgtgttggatatgcattaccacccggtccaggcgttggacaacggtcacatccggtccaggcgttggacaacggtcacatccggtccaggcgttggacaacggtcacatccggtccaggcgttggacaacggtcacatccggtccaggcgttggacaacggtcacatccggtccaggcgttggacaacggtcacatccggtccaggcgttggacaacggtcacttccggtccatgcgctggacaacggttatactcagtccatgagttggacgtttatttcatgtagtctatgttctggacacttaatcgttttctgacacgtcacccatgtgagtatgatatgacacttatgtagaatacgacaaggtattcatgtaggtcattacctaatactgtatttatgtctgagatgggttgtatttcttttttttacttgttttctgttcccgtattagactctgggtttggtacttagggattttcaatttgagatacaaggtatatacatgagggtttccttgtttggattatttcgctcgacgtacctatgctcgtgttgaaatttcctaagtactaagaccccctttgcttcagggaatttgcttatacatatacattttgtgataactgtattttcttatacaatgagccctctcccttggggttggttgtgatgttgctcgctagcgctttgatgctcgttgtccctccccctttcaggtcacgagccaggagcccggagagtcgcaggttgatggcgacacactttagtgttcagctatcttttctagctatgctttatgttggagctccactgtagtatttgttagacatttgaggactatgttataattgttgtaaaggctgtatgccttatttcctttactcagacttattgtatttgaggcttgttgaaaactccagtttgttcatttcagactttgactttgtacttcggtatgttggatgatgaaatgttattatgatctctaccatttcatcagctattctctgtattatcttttacttgcttttgtatcaacacctgttattgactctactagagtgatagaattatgatggtgaaacatattaatgtacggtgtggtgcatggcaggtttgacattcttggtttcaccgaggactgcagccttgtgtgaacccaggggcgtcacagtatgaccctcgtcaaaatagccaacaatgttggacatgtgaagtgcaacttgcgaataaggctcatcgaaagatgaaacaagtcatagagacgagaatcatcgatgacgagcctcatccagtcaaaaagacgtcatctttatgatgagtctggaagaaactgttcatcttcctcaagaaacccaagtctcaaatagacagggttgacatcccttagaacgcaaattatgcgtttaagatctattacctgaaaagctgggtagaacgccaggttcgtgcgaagagctagcaaccttcttgccctgactcttgcttcggtttacagcggtcttaggggccattgatttcgcttgaagagcttgcgaaaaaaagaaagatcagaattttgagaagagaaggagttcagataacccaaacgacgaagagagaagaaaggacttctcatattatgataccctatttataggaacgggaaaagagtcgaatcaagggccgcgatcttcagttagggtcgtttgacgagatctctccccaacaagatctacggacgggattcaaggggatttcctatcaccagctagcaaccattcgctaggtctgggaaaggtgcatagcagtgatgctgacgaaactacaataggtcatttgtcagacgggacagactccagaacgaacaacaaaataactttcgcgaacacgaggttcacgataaaaccaggttcgtgaaataaactcctcaggttcgagatacctattcaaagtatttcagactacatacaacccgattcaagtctgaaaactttgaagggggttttgtagacattaaaaaatgccaaaattcgaaaggtgaaaagagaggtcagggaaacgaaccccttttcaatcagaaacgaggttcgttgtttagaaaagatcaacctcaagaacaagagtcaccatgcagcagaactcaacatcgaaagataaagttcattattgaatgaaacggatctacgagactcggagctcgtcattggacgagagtacgttgaagctcgtcattggatacgaggttcgaagttcactagtggatacggggttcgaagctcgtcattggacacgagttagactctagttgtcagagatgaatctcatcattggatgcgaggtttggagttcattattaaagatgaagttcgtcagtgaagacgaagcttacgaggctcgccaagcagcgagtctcgccatcaaagatgaggtttgccaacgcagtgaagttcgtcacccgcattaaatcaggctgtaacggtcatgaagacccagtcagccacgtggactaaattcaaagagtcagttacgccacgacttcgcaattttagcgtatcagttacgcccacgactccactattgtagcacgtcggttacgtgctcaaactcctataaatagccatcgatggctacagagaaaggggttggttgattactctgaattggagaattttaagcttggacttagagatgcatcagagtttaaagtttctacatgtcaatccggagttcgaacctcgattccagttggttaacctacgtcagaagctcttgcgatcttggtctgatcgtcaacaggaggcaagcttgactcaagcatcaggggaagcatcctttcgccacctgataatcacattttattacaattttataccctcattatcgattttatatgaataaatataccactaataattgcttttatctttaattgcaggttaatgaagaataagagcccaaactctcatctctcaataaaaagccctcgatttaataaagaaatgaagcccatgaagccaaaggaattctttcaaatatttaatgaagaaataattcaaagcccaatggaaaatcaagagaaaatgccaagcccaaaagtccaagccaaagcccaagatacaagcccaaaagccaaatacaagagttctgaggacagcaaccagaagaaggtaggcatcgatgcctgcatcgatgggggcatcgatgcctatatcgatgccagcatcgatgcctgtatcgatgcctgcatcgatgccatcgtacagtttgttatagatctaaggctgaaatttgttatttttggataagatttcaatccaatagctctcattcagtgatgtttactataaatagggatagagagtgaggggttaagggtgtgaaaaattttgtaactctatttggagaggagggctactcttaattgagaaggccttccaaaaattgtaacttttattgtaattaataaaaataattttttcctctttaaatttgttctttctcctcttgttgaatgatgaggatggagatgaagagcaaattgaaggtttgcatttcttttctcttttatttctttttagtaatttctttattattgcttattagttagatttaaattcaataataataatttttctcctctttaaattttcttttctcctctttgttgaatgatgaggatggagatgaagagaaatttgaaggtttgtatttcttttatttttctttttttatttctttttagtgatttctttattattgcttattagttagatttacatttatgcttgtagtgtagatttattttcttgtctttttatttctttttgtactttattttgtagagtagatttattttcttgcatttaatttctacaatttattttgtagtttagatttttattctttgcagttagatttatttcttgttcatagtttagatttttcttttctttttatttttgtaattagttcttttttcttgttttttttatttcttaagatgtgaaattaattcttgtaggaatcttagaattacataaaactagtctaatttcctttatattgtatgaattattctcttgcacttaaaatgttcatgtttaggataatcaactagagaactaatcggtagaagaagaatttgataatctatgcttatcttaaatggtttgataggttatgcttatgaattctaggattattatcatgttgttgttcttatcatgaatagtaattttaactatacttttcttaaatggtttgatagtctatgcttaataaatctaagttgaattatgataaaaatagaaaagtttgtattttgtaattaaaattagctagtgaattatattctagatttcttacctcttgtgaatcctccatcttgactttatttaatttttctttttattcttgaatttatttcttgattttattctttcttctttcttgccttgtgattttttaatttttctttttattcttgaatttatttcttgattttattctttcttctttcttgccttgtgatttcattcattctttgattcttatttcttttctctaaaattcaatttattgttatttgcacataaatcaaaacaaccactcatcatatctctcatcacaatcacacttattctttaatcctatcttgtcacacacaaaacagaagaaccaattctaataatctcttaaaatcaccttcctcgtgggatcgataactttttatactataacttgatcaattgtgcacttgcaattttggtacataattatgccgtatcaagtttttggcgccgttgccggggacggtgcttaaataggattttattattttggttctttaacttgtgtgttttcttgtgaaggaaccgcttggagcttgaaagtcttggattgaagatcaagaatttagagaattgctttcgggtaagtcctctttttagttttcaattctaccctttttagttagcttcacaattagagacacttaggatttaaaaaaaaaacaaaaagattttatttttgttgaccataataaaacccacctttcacttggacattaactaacaagataataaattcaaacaagagacctcttctcatatttgattgttgttgaccataattaaaaaaaaagattttctttttatcatcatttttagtcgcttttaatttctagggttgcatttcatatagtataggaattcaccaaagtgattgtagcacttaatttggcacacacttaaaacattcttaagggcaaaacccataatcaagataaggtaagggatttcatcaccctttccttagcccacaaatcactaattcctcacttcacaacccaagccttctaaaactcattagacgttggcccctaaggattcgagctcaataaggaacaagaaatccttaagtgaaccagtttaagttttctcagattagttggtgtctaaggcaaggtttaggggtttcgtaaagcgctccgcaaggaatgaggtacttaattgatctctgatcaacctctagtactatccttacctggctaactacctgggtaaaactttaatcttttcactgtaggagtttttggttaggagctggtctagttgagttaggctaaaccctagaattagagtgtgattgaaaagtgattgatttgatttgttttagttaggatttttcttctcataaaaaaaaactaagtttctttctctccttaaaagaaaagaaaaaactaattttcttccttccaaaaaaaaaatgttttggtgtatgcaaacttgggttcgggataattctcatcgtttaatccgtattgaaccaatccaagaaatggcaaatcaacctgttcttcaggctatgtgttaccccactagaaatgcaattccatcttgcataagactccccgaagtaaatggagtaaatttcgagcttagaccgcattacataaacatgcttcccaaattccttggtaatgaaacagaagatgcatatatatttatatcggaatttgaggaagtatgtattatgattaaaatgagagaattaactgaagatgcgattaaccttagatttattccatttgctcttaaggacaaacctaaaaaatagctgtacagcttaccgataaattctatctcaacttgggaggaatttgtcaccgtttttcttaaaaaaattttccctattcataaaacggtaaagcttaggaacagtattcaaaacttcaaaattgtcccagcggagccattctggaaatattttgaccgatttaaagatcttttaatccaatgtcctcatcacggtctagaaaaatggtgactgtgccaagtcatatatgaaggattggactattcttcaaaaacatctttagaatcgatgtgtcagggagattttatgaggaaaaacgccgatgaagcttgggaattcctagagagtctatccgagaaaacaatgcagtggaaaaactatgatgatagggttttatctgtttcccaatctaagtctagtggtctttccctggagtcaaacattgcttctgaagcaaagatggcgacaattctgcggaggttagaagccttagaagttaaggagcgagctccagctcaaatcaatcatatttttgccccgggatgtcataactgtcagtcttctacccatgtttcagaggaatgccctctcctaggaaacaaccatgctttagaacaaatgaacgctgcattccagcaccctagaaatgatccattttctccaacctacaatccaggttggagaaatcatcccaattttgcttggaaccaaggaaattctcatggaaaccaaaacttcattcccgcgtcgaaccaacaattccctaggggaaacactgtcccattcaacgcaccaaacaattttcaaaaagctaaccctatttttccaaaccaacatcctcatcctcaccagcctacaaatccttcaaattctgatcatgacaaacatttgagtgtcttagaaaagggtttagaagttatgatcaaagcttctacacaaacgaccaacatgttgacccattcatccaccactctaaattctttcatgcaaacaaccggccaagtgctaaactcaaacactcaagccatagctcggttagaaacccaacttgggcaactagccactaccgtaagtgagagagaaaaaggaaaattcctaagtcaacctgttacaaaccctaaagacactggatccagttccaacaatccagcttaattgaatgtagttcacacactgcgatcaggaaaacaaatagacaaccaagttagaatgccaccggatcaaaccccttctcccatccaacaaactccttctgatgaagcaattccttccgatgaccaaagcgctgaacttgagattgaacctgatctagataggtataggcccgttgccccctttccagatagactcaaacctagaaaaaactccccgcaggttgagaaaatcctagaaacatttaaacatgtcaagatcaacatccctctcctagatgcaatcaaacaaatcccttcttatgcaaagttcttgaaggacttatgcactaagaaaagaatcaccaacgtccccaagaaagtcttcttagctgccaaccttagtgaaattttttcaaaacccatgccgttgaaatacaaggaccctggttgtcccacaattccatgcgtcatagataacactcacattgataaggcacttctagacttggaagccagcgtcaacctccttccttattcggtctatcaacagctaggtgtaggataacttaaaccgatgcatgccctttggactgtgtaacgtaccggccacattccaacgttgcatgatcagtatttttttcgacatggtagagcgatttctcaaaattttcgtggatgacttttccatctttggtgacacattttcccaatgtttgcatcatcttaaattggtcttagaacggtgtagggagaaaaatctgactctcaattgggagaaatgtcatttcatggtcaaacaaggcattgtcttaggacatgtagtttccaataggggaattgaagtggacaaagctaaggtagatctcatttctaatctccctcctcccaaaactgtcaaagatgtcagatcgtttcttggtcatgctggtttttaccgacgtttcatcaaggattttagcaaaattgctagacccttgaccaatctcttagctaaggatacatcgatcatttgtcttctcccccgactgcctcaaagctttcgaatatctgaaaaaggagctaaccacagctcctatcattcatgcaccagactagatcttacccttcgaactgatgtgtgatgcatctgattttgcgattggagctgttttaggacaacagtttaacgaaaaaccgcatgtgatctactacgccagtaggaatctgaatgatgcccaacaaaattattctgtcacagaaaaagagtttttagctgtagtctttgccttagaaaaattcaggtcctacctcatcggtttcttaaccaaagttttcacagatcatgccgcagtaaagtatattttgaccaaaaagaatgctaaagcacggctcattagatggattctccttcttcaagagtttgacatccaaattcttgacagaagggaaacagagaaccccgtagcagatcacctttctcgactacagaacgcaccaacattaaccgttctgatcaatgagcatttccctgatgaacaactcctacaaatccaatctgttccatggttcactgacattgtgaattacatagtcatgaaccagatcccttctcattggtccaaacaggatagatcatgttttctctcctaagtaaaatacttttactgggatgatccatatctgttcaaatactgttctgatcatatctttaggaggtgtgttcccactgaagaaactaggagtgttctatcattttgccatgagcaagcatgtgggggccactttggcccgagaaaaacagctaaaaaagttcttcaatctgggctgtattggcctactctcttcaaggattcattcgagttttgcaaaactctaaccgctgtcagcttttagggaaggtcactagaagaaatatgatgcccttacaacccatcttatctgttgaactttttgatctgtggggtatcgatttcatgggaccatttccaaattcctttggaaatgtttactttctagtagccgttgaatacatgtcaaaatgggttgaggcggtagcttgcaaaactaataaaaacaaggtcgttgtcaagtttttgaaagagaacatttttgcacggtttggagtaccccgagcgatcatcagtgataacggtacacatttctgtaaccgttctttcgaagctttgatgagaaaatattcaatcacacacaaattgtcaactccttatcacccccaaagcagtggacaagttgatgcgggacgatgggacttttagggttttatgtaagggatttgggaaatttggggaagaacaaagatttggggaaaactagggtttgaaagattaacaagatatgaccacgaatcgcaacccgggccttggcttcaccaccattgactcaatcttagagatcaaatcaattacccaaagtttcacaaatgaaacaaaattttcttcaaatattcattgatatatgtgcgaagtggaggctgtgcgatgtcctcatcaattcccccggggtgggaagaactcgaccccgtcgagttaggctccaactggccctcataatactccaatagatccggagccaggcgctgcaggtcctcacgagtaatccatgtatcatcagattcaggacgatctttccaacgtactagatatcgtctgcaaccaccatctctggtggagatgatttggtcatctcgaatgctatcaatctgttcagctgtaaatgggacaaaagtagtaggcagtggtggcaatgggggtccctcaaggaaaggatcaggggtaggctcatcaagatccacaagtggcttttcagggtgaaaaggatgacctttataagctaccaaatctgcaatattaaatgtcgaactaattccaaaatctggaggtaaatcgattacataagcatttgagttaattttcttgataatcttaaaaggtccagcactacgagcatgtaatttcttgacggctccaggaggaaaccgttctgggcgaattcggatcattacataatcaccttcgttaaactcaagatgtcttctatgtaaatcagcatgagatttatattgttcattgctttcttgaattttcttgttgatttcttgatgcaaatcatgaatgtgtgatgcaaatgcaactgctgactcggacaccctaggatgatgcgacatgggaataaggtctataggcttcctaggcttgtaaccatgcacaacttcaaatggactcatgcctacagacctattgactgagctattgtatgcaaactctgcagtggataacagaagatcccaatttcttaaattctcaccaaccaaacagcgcaaaagattgcctagactcctattaactacctgagtttgaccatcagtttggggatgaaaagcagacgaatactgaagtttagttcccatcttgtgccatagagttttccaaaaataactcataaactttacatccctgtctgatacaatggttttgggcaaaccatgcaatttgaccacaccatcaaagtagatccgagcaattttggatgcatcagacgttttgttgcatggcaagaagtgggccatctttgaaaagcgatccacaactacaaaaatggagtcatgttttctgatagttttaggaagtcccaacacgaaatccatacttacatcctgccaaggacgatctggaacagggagaggtgtgtataggccagtattttgtttacgttgcttcgctaattggcaagtgcgacattgtcctattaactttgcaacatctcttttaaggcttggccagtaaaacaaagtttctaccgcctctatagtcttttcatgaccaaaatgaccagcaaggcctcctgcatgcaattcccaaacaagataatctcttaaagaagtacgcggaatgcataacttgcgaaatcgaaataaatagccatcttggaacaaaaagccatctatctcggaagtcactccttttaaagaaacaaaaatctctccaaagtcggggcatgattcatactcccctttgattctttcgaaacccaatacctctgcactcatgcggtttagaagacaagctcgacgactgagtgcatcagccaccttgttctcaactccagccatgtgtttgagggtataagtgtagtcttgtagaaattcaacccatcgagcacgcctggcattgagtttcttctgagagttaagataccgaagggcttcatggtccgaataaataacaaattcttgtggtaaaagataatgtcgccaatggcgcaatgattgtacaaccgcatagaactccttatcgtaggtagagtagttcagtttagcaccctaagtttttcaataaagtaggcaatggagtgcttctcctggctcaatactccacccataccaatactgaggcgtcacacgcgacctcaaataccttagagaaatcaggaagtctcataacaggtgcatcggtcattcgctgcttaatttctttgaaagccgtggcagcttcttcggaccaacgaaattcctctttttttaggcaatccgtaattggggccatgatagcactaaactccttgataaatcgcttgtagaaagttatgagcccatgaaaactgcttacatctcggatactccgaggctcgggccactctacaattgcctgaaccttttgagggtcaacagaaactccttgagaagacacaacaaatcccaaaaatataacatggtcagtcatgaaaacatatttcttgggatttgtaaatagtttctctttcctcaaagtgagacatgttgggattttaaggagattaatctgtggaattaaacactaaacgaataacgacaccaataaaaaatatcacaagtaagcaaacaccaagatttaacgtggttcggtaaatcgtgcctacgtccatggggcaattcagagagaaatatttcactatgaatcgagagtacaatccctccaagttacacctaaacttgaggattaaatcataagagaaaaatatagtgttacctctagggcaccaaaaccctaaaacttatctcaccaaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatatatatatatatatatttatacataattactcattttgttaaaaaaaaagacaaaacaacaaaacaaaacaaaacaacaaaatttgaataagtaacataggcctaacaaaaaaaaaaagaaaaataaaaagataaaataagtgttggcccacaaatcaggcccaaaagaaaaaaaattaaagaaaccgtgtttgggccggctggcccaaacaccatggttctgggcatcgatgcccgcatcgatgctccacccagcagcttttaaaaccgcagccccaccccaagccactttcttctcctctttctttcaactcccaaacccgatttttttccccctcaaaccctaatcccccccacacaagatcaagatcacaaggaggagatttcttcactatttttggccttcttccacctccactcatctacccaatgtattgtttctaacttgatcttataatttttatgaatacatggatgatttggtgattgaatcataggtagttgtgaatgattatcatattttgtgttgattcatgatcaatttagtaaatttagggtttaatttggggatttgccaaaatttggggattttgttcaaaaaaaaaaaatccgaaatattggggggatttatgcaaaattcgaaaatttctagggggtttgaacttagaactcaattgaggatatcttgtacaaaaatttgaaaaaaaaaatattttggggtgttttgtgcaaaaccgaaaaaatttggggtgtttcatgcaaacccgaaaattcttagggtttttgtgcaaaaacaaatactttttgaacattcaattgagtacgtgatttcaaaaaaaaaacttgaatttagggtgttatgtgcaaacaattccaaaaaaaaaattaaggtttagcttataattgtaatatcaacatgtggatttcatcgatcaagttatcaaaattttaacattgttgttctaaaagaacaattttgaggaaattttttgtcaaaacaaaattctgataacttgaaattaactcatgttgaacaatttgtagctaaattcttgtcaaaaaataaaaataaaaataataataagtaaataataatattggaattttgttattaaatttttttcttttctttctttttctgtagatgcccccagaaagaaatttcgagcaacttcatcatcttctgatccatctgataccgacatagatagacccactattttagccaaaattatgggtcttaacattcattttgagaggggatttcagatgagtgcattacatacatatcattccacagtcaccatgttaactgcagtaggtcttaggagcatgatgactaaacccttagaaaaagcaaacatttcattagtgcatgagttctattctggatgggagattgatccagatagagaatattcagctttttctatcgtgaggggtgttagggttattttcgatctttccactatccgtgctacccttgaccttgcagaaccacccactgatgtaccagattacttccatttagcctccacattacagcctggtacactagaatacaacaacatgtctgcaaccttgtgtgggaggatctttacatctagtttcggttcaggaaatctcaaaccagaatatagattacttaatcttttcctgaactttgatttgaaacccaccactacatactctgtcattaccccacacgatattctccttctcttttggatagccactggtttgcgatttgatatagcgaggattatatttgtatgtatgcgctcatcagtggagaatgtgttggattgggtcagaacacagtctgcatcacgtactcagctcatttacccctattttatcactaaactctgccatagatttcacgttccagtgttcgcagaggataggttagaaggagggaaggggttactaaatgatcagactgtgaggaggagcatttcagggcgagatcagtccggtccttcaggtagagagcctcctcagcaccagccagttacacaggatcctattcgagaggagatggacagaatgcggagtcacatggataggatgcagatacagatgcacaggatgcagcggaatatacacgagatacatggtcagatgagatactccactgataccctggcatatttggtgagaggatggcagagagaacatggagatacagatggacctctacctgagcttcatagttatatcacaccatttcagccagatgatttcccaagagaggatgaggcgggaccgagttcagcagctgccgctgatgatgtggatgacgatatatcaggagatgagcagtgagggatgttctttttattttaccctgtctttgatttttatttcggcatgtacttattaaactgtgatattctagatattatttgccttgaggacactgcaaagtctgggtatgggggtataagctagttagcttttgtttatatttttctaattagtattttgtttcagtttttttctctctcagcatttatcttttgttagtttaaaattttttttttcacttaccaaattaatagagttaagtaataattgatctaattgatagattttaaattttctaatccttagttagtgacatactcaagttcaccttttattataactccaaataaaattcttaagaaataatttttcaagtagtatactttacttaagtcttatcttagattttttaattaaaaataataaaatttttccatgcttaactcagagttgaaaatattttttttcaagttatcttgatttacacacttttttcagactatatatacttacacacatatataaaaaaaactaaccttataaaagaagagtgcaaaaaatgggcacaaaaaaaaaactcttaaattcaaggtgattctatcttataaagcctaagttgactgagtaattaagcccaaggagtatctctatacttcatgacctaagcccaattgggttgggattcattggcccaaaactcattaaatggtcacttagaaagcccgttaaaatagaaaacaatcaccaagaattagagagtgaaaaaaaaaatatatataacactaaccattgtttatatatatatattgttgttttgtatatatggtcttgaaaaacaatttttgatcaagagacttgaaagttatttaaaacaaagagttggcatgttcttttcaaaactttttaattaaatttctaagatttgacttggttttgtattgctataatgaaaaagattttctaggggatttacattggagttatatataaaaacgttttcttgattattaactagcttcaattagaatgtttaaatatatcaaggaaaatctgttatttactgacttatttaacttggcaagttgaccgaattttatgggtatatcaccgcaaaccctcacgagactacaactcgtccactagggtaacctaggggtttaaaggctagttgtatgcgctaaatacaacctcgattcctgcgaaagtgagttaggattttctttttattttctttgctagaggactagcaaaagtttaggtgtgggggtatttgataatcacattttattacaattttataccctcattatctattttatatgaataaatataccactaacaattgcttttatctttaattgtaggttaatgaagaataagagcccaaactctcatctctcaacaaaaagccctcgatttaataaagaaatgaagcccatgaagccaaaggaattctttcaaatatttaatgaagaaataattcaaagcccaatggaaaatcaagagaaaatgccaagcccaaaagtctaagccaaagcccaagatacaagcccaaaagccaaatacaagagttctgcggacagcaaccagaagaaggtaggcatcgatgcctgcatcgatgcctgtattgatgcctgcatcgatgcttgtatcgatgcctgcatcgatgccatcgtacagtttgttatagatctaaggctgaaatttgttatttttggataagatttcaatccaatggctctcattcactgatgtttactataaataggggtagagagtgaggggttaagggtgtgaaaaattttgtaactctatttggagaggagggctactcttaattgagaaggccttccaaaaattgtaacttttattgcaattaataatagtaatttttctcctctttaaattttcttttctcctctttgttgaatgatgaggatggagatgaagagcaatttgaaggtttgtatttcttttatttttctttttttatttctttttagtaatttctttattattgcttattagttagatttacatttatgcttgtagtgtagatttattttcttgtctttttatttctttttgtactttattttgtagagtagatttattttcttgcatttaatttctgtaatttattttgtcttttagatttttattctttgtagttagatttatttcttgttcattgtttagatttttcttttctttttatttttgtaattagttcttttttcttctttttttttatttcttaagatgtgaaattaattcttgtaggaatcttagaattgcataaaactagtctaatttcctttatattgtatgaatttttctctttcacttaaaatgttcatgtttaggataatcaactagagaactaatcggtagaagaagaatttgataatctatacttatcttaaatggtttgataggttatgcttatgaattctaggattattatcttattgttgttcttatcatgaatagtaattttaacttagatgataatttgataggttatactttccttaaatggtttgatagtctatacttaataaatctaagttgaattatgataaaaagagaagagtttgtattttgtaattaaaattagctagtggattatattctagatttcttacctcttgtgaatcctccatcttgactttctttaatttttctttttattcttgaatttatttcttgattttattctttcttctttcttgccttgtgatttcattcattctttgattcttatttcttttctctaaaattcaatttattgttatttgcacataaatcaaaacagccactcatcatatctctcatcacaatcacacttattctttaatcctatcttgtcacgcataaaacataagaaccaattctaataatctcttaaaatcatcttcctcgtgggatcgataactttttatactataacttgatcaattgtgcacttgcaattttggtacataattatgccgcatcaccacctagaacccacgttaaacaaaagagaagatgaattaatcttctcttcatctgtaatcgagagagagcgtgagtgattgtaagggtttcgtaccaagtgattgaacctatttcttaaaacaagaaaatcaatcccaacatcaattttttgacccaacactcatcgaacgtgatatctctccttagcacaatcttcctatcaactggatctcaaagcttgtatcccttgacaccaagcttgaatcctataaatatgaccttcctagctcgaggttccaacttattagtcttcacatgatagtatgcagggcacccaaataccttgagctagtcataatcgtgtgctggctctcccgatcacatctccataggggtcttcccctcaatcgcagatgaaggcatcctgttaatgaggtggcttgcatatgaaaggcctcagcccaaaagatcttctccaaactactatgtgccaacaaacatcgtatcttctccaacaaagaccgatttaacctctctgctaccccattctactgtggtgtttgactaactgtgaagtgtctctctatgccctcgtctcgacataactgctgaaaggggtctgatgtgtactcatcaccgttatcggatcgtaacgtcttgatctttctcccagtctggagttccaacctcttctttcactccacaaatatatctaggactttactcttcttcaccatggtgtactcccaacaacgcttagaatagtcatcaacaaacatgacaaaccgatatctaccaccaagtgatgcagtcttggtgggacccaaacatctgtgtgcacataatccaggatgcctctcgtcctatgaatgactgtcccaaacttcaccttcgtcttcttgccaagaacacagtgctcacagtgttagcccttatgttttgatgatattttacaaccaccattatcggtactaatagtttattgagtgaaaatgtagcaaattcatttatcaagctcgttagtgccattaacggaggatggatggaatatacgctacaacgaagatatccaaaggaggaggaggccaagagatgaagcaacgttatttcaagaacgtcaaattcgactaaaagcttcttccgattcaagctatatcaaagctcaagtattgctctctatatgaggatattagctttcttttgtttccctctctagtgctagaatgtaggcaaagagttactaagtttacttgaagctattgggaatcacacacacgatttcatacttatgtttttaagcgtttttcacaaaatactatttttcacaagtatgaggacctatctgcaaaattctttttccaaacagtttgtttttagtattaaaaacattttacaaagtttcagatttttcagaggtcaaataaatattttgcaaatatttaaagttggtcaaaaactgttttctgcaaaatgtcagaaagcggtcgaccggtccggtcgaccgctcccatcgcctttcctcactattttccagagaggtcgtcggttgaccggtacggtcgaccgaaatcttgattttcaaatcggtcgaccgtgccggtcgaccgacgatggttctgcttgttttccaagttttcgaagcagctcgcggtcgaccgaatttttcggtcggtcgaccgacgtgatttttcggtcgaccgaaggtttatttcggacgaccgaaatttccttcagtcaaccgcgacttttttaaaacggtcttctgccttgatcaccgtgctttcacttaatggtgattagcacagtctgggctgggagtctgaaaaggagattacttgctcatttgggacttttttcttctgctgtgagggtgagatcttgtgtaagatctactgtgagggtgtgatctgttgagatcaaactgtgtagtgagagagatcgtgtgggatcgctgtgtagacgaagttccggcttccaaaccgggtgtgtagtggatttctcctcgagagtggggagcggggacgtaggccagagggccgaacctcgttaacacatcgcgcgtcaaggataacgaactcctaaccctatctctcttacttttatcgcatttttgttttgtgttttgcttgtgctgaatttatattgcatattagagcctcttgaccctaatcaccccccctctagggtccaacaattggtatcagagcttggtctctatatcagtttttagtttaatcaccttagagaaaagatctaatggaggcctctttgaatatgcatatgttagaaggacaatccacaactagaccaccactcttcacagggactaattttgcttattggaaggctagaatgagaatttaccttcgttgcattgatcttgacatcctagggctcatagaaaaaaaaatatgtagagaagtccaaaattgagaacatgtccgatgatgaaaggcaccttgccaatctcaatgctaaggccatgaacgccttaatatgtggtctttccccaaatgaatacaatagggtttccacgtgtgcaaccgcatacgaaatttggcaaaaattatgtgtcacacatgaaggaacaccccaagttaaggaatctaagattagtggactcatgcatgattatgagctatttaaaatgcttcctaatgaatccattgatgctatgttttcccgttttactaatatcatcaatgaattacatggtctagataagcaattatccattcaagagatgaactacaagatacttcgctcattgactccggcatgggagcccaaggctacggccattgaggaagctcatgacctcactaccttagctcttgatagccttatcggaaagctcaaagtgcatgagaagaagctcaaggggaaggagaaggaggaagtgccatcacgagaagttgaggagccgtcaccaaagttgaagaccatagctctcaaaggagctagtgacaactcatcttcatcgtcggagagtgaagtcgatttttctagagaagtggctctcatctctcgaagaatctctagacttataaaaatgaacaaaaaatttaaccctcgatctaacaacaagttttcctctcgtgtaggtaaaaattttgagtgcaatgaaccgggtcacatcgctaaggattgccccaagctcaaagaaaagtacatgaagtacaagaagaagaaggctatgtatgccggatgggaagaatccgaaccaagtgactcggatagtgatgaagaaggagccaaacttgctcttcatgacccaaatgtttgtttcatggcaaatgaacatgaggtaatatccgaggccgaaagtgaatctttttatatgcaatgtgacatagctatggctttagaagagttgaactttgaatttaaaagaatgtctaaagaatactcttctttcaaaaaattgcatgcctcttgtgatattaagctagaacaactaacaacctctcttgctcttaaagatgaattgctaggagatctcgatttcgagaataagcaattaagatcaaagattgaaagattagaaattgagggttgtaggactagacccactcatgcttatgccaactacaatcaccatggtagaaataggtttcatggttctaacattcgtacatacaaaagaaattttgtatgcacctattgtatgagacatggacacatttctactcattgtagaattaaagacaatgaagatttttatggtttgatatgggtacccaaaggtaccaaaactactaaccaccaaggacccaagacatgggtacctaaagctactacaccttcatcttcttcttttgtagggaacgtcacggcaacgacgtaaggagatgtggtaccttgatagtggttgctcacatcatatgacgggcaacaaagagttatttgcaaccctatcaaggattgaaggaggcaatgtctccttcggtggtggtgagaaaggtaaaatcattggtatcggttctattggtaagaaaccctcacccattattgaagatgtctatttagtaagtggtttgaatcataatcttcttagcattagccaattaagtgataaaggttttgatatttcttttaaaccggataaatgcatcattagtatggatggaaaaattgtttttattgcaaatcgcaagtctaatgtttacatttttgagatgaatgagttagtgaatcaagatgtgaagtgtcttgcggcaattgatgaaaatccttggatttggcacaagagacttggacatgcaaatatggagttaatatcaaaattgtctaagaagaatcttgtgaaagggctacctagcttgcacttcataaaagatacaatttgtgaggattgtgccaaaggtaaacaaacaaagtcttctttcaaatccatccatgaggtatcgacttctaaacccttgcaattacttcatcttgatttatttggtcctatgcgtgttacctctcttggaggcaaacactatgtttttgtgattattgatgatttttctcgttttacatggacaatatttcttgcaaagaaaaatgattgttttgaagaatttgctaatcatgttaaaagaattgaaaatgaaaaggatttgaaagttgttaaaataagaagtgatcatggtggtgaatttcaaaatgaatttttctatgatttttgtgctcatcatggtataactcatatgttttccgctcctagaacaccacaacaaaatggtgttgttgaacggaaaaatcgtaccatacaagagatggcacgcactatgttaaactcatttgatttaccaaaatacttttgggcggaagctgtcaatacggcttgccatgttttaaatcgtgttttgattagaccaaagcttaagaaaactccttatgaactttattatggaaaaactcctttcattggttattttcgtgtctttggttgcaaatgctttattttaaatacaaaagatcaccatgataaatttgattccaaaattgatgttggtattttcttgggttatgcacctcgaagtaaggcttatagggtcttcaataaacgaagcctcgttgttgaagagtctataaacgttacttttgatgagactaatgttggctctcaagttgtgttgcctaggaaagatgatgatgatgatattgagggaggattggacttgttgcaaatcaatgacactccctctatagaagttcaaaaggatgtagatagcaccaatgctcaagaacaagttgaaccacctaaagcttggaaattcacatcaaaccatccaaaggaacaaatcattgggagcccttcaaaaggagttataactcgctcaaaagccttgagtgaatgtggtaatgttgcatttctatctcaactagaacctaaaaaggttaatgatgctttaaatgatgagttttgggttttggctatgcatgaagaattaaacaattttcaaagaaatgaagtttggaagttagttcctagacctaacaatgctagtgttattggtacaaaatgggtttttagaaacaaacttgatgaacatggcattgtaactagaaataaagctcgtttggttgcccaaggatacaatcaagaggagggcatagactatgatgaaacctttgcaccggttgcaaggttggaatctattaggatgtttttggcatttgctagctttaaaaatttcaaactttttcaaatggatgttaaaagtgccttcttaaatggctttatagaagaggaagtgtatgttgagcaaccccccggttttatagatcatgcttttcctaatcatgtttaccgggtacaaaaagctttatatgggttgaaacaagctcctagggcttggtatgctcgcctctctagttttcttattgaaaatggtttttcaaaaggaacaattgataacacactttttgtgagaaaaaggaaaaatgatttcattttagttcaaatatatgtggatgacatcattttcggtgctactaatgaatccttgtgcaaggaattttctaaagtaatgcaggatcactttgagatgagtatgatgggagagcttacattctttctcgggctccaagtcaagcaaactaaggatgggatcttcatttcacaaagcaagtatgcgaaggaattggtgaagaaattcaagttggagaattctaagcatgcgcctactcccatgagtactagtgttaagcttgatgcggatgagagtggtgaagatgtggaccaaaaactataccgaggtatgataggtagtcttctttatctcaccgctagtagacccgacatcatgtttagtgtatgtgcatgtgcacgttttcaagcctctcccaaagcgtctcatttaattgcggttaaaagaatcattaagtatgttaatggaacttttaaccttggcttattttatccaagaagcacctcttttgatttatatggtttttgtgatgccgactttgccggatgtaaggtagatcgcaagagtactagtggaacatgccaattcttaggaaattcccttgtttcttgggcttccaagaaacaaaattgtgttgcattgtccactacggaagcggaatacattgccgccggcttatgttgtgctcaagttttatggatgaaacaaagtttagttgactatgatttgaattttcaaaatattaaaatcttttgtgataacacaagtgctataaatatttccaaaaattcggttttgcattctagaactaaacatattgatgtacgccatcatttcttacgcgatcatgtagagcgacaagatgtatccctagtatttgttgacaccaaatctcaactagcggatatatttactaagcctcttggagaggatgatttttgtcgcataagaaatggtttgggcttatgcactatgtgaaagttctacattgcttgcttgattagttgcattttgcatttggcatttctctttaccccatttttgatggtgacaaagggggagagaaatctcctcatttgttgcatatatttagggggagctcatagatagggggagcacctatctataagctattttatttttgctcttatataatggttggttgtcatcataaaaaaggggaagattgttagcccttatgttttgatgatgttttacaaccaccattatcggtactaatagcttattgcgtgaaaatgtagtaaattcatttatcaagctcattagtgccattaacggaggatggatggaatatacgctaaaacgaagacatctaaaggaggaggaggccaaaaagatgaagcaacgttatttcaagaacaacaaaggcatataaaagcttcatccgattcaagctatatcaaagctcaagtattgctttcaatatgaggatattagctttcttttgtttttctctctagtgctagaatgtaggcaaagagttactgagtttacttgaagctattgggaatcacacacacgtttttagacttgtgtcttttaagcgttttttcacaaaacactatttttcacaagtatgagtacctatctgcaaaattctttttccaaacagtttgtttttagtattaaaaatattttacaaagtttcagatttttcagaggtcaaataaatattttgcaaatatttaaagttggtcaaaaactgttttctgcaaaatgtcagaaagcggtcgaccggtccggtcgaccgctcccatcgcctttcctcactattttccagagaggtcgtcggtcgaccggtacggtcgaccgaaatctcgattttcaaatcgatcgaccgtgccggtcgaccgatgatggttctgtttgttttccaagttttcgaagcagctcgcggtcgaccgaatttttcggtcggtcgaccgacgtgatttttcggtcgaccgaaggtttatttcggacgaccgaaatttccttcagtcaaccgcgacttttttaaaacggtcttctgccttgattactgtgctttcacttaatggtgtttggcacagtctgggctgagagtctgaaaaggagattacttgctctttttggaagatagggttttattttaaaatgatttaaactcttctataaaaagcgttctgtttcctgagaaaaattttcaaagcctgttttctctctgttttaagtgtgtttcacttcccagcttcagtaaaccttctctttgctataggggctgtgtaaagagaggttcttgcatcttttcttctgctgtgtgagtgagatctgttgagatcaactgtgagggagagtgatctgtgagatcaaactgtgtagtgagagagatctgtggagatcgctgtgtagacgaagttccggcttccaaaccgggtgtgtagtggatttctcctcgagagtggggagcggggacgtaggccagagggccgaacctcgttaacacatcgcgcgtcaaggataacgaactcctaaccctatctctcttacttttatcgcatttttgttttgtgtcttgcttgtgctgaatttaaatccaccactagaccacctctcttcacagggaccaattttgcttattggaaggctaggatgagaatttaccttcgttgcattgatcttgacatcctagggcttatagaaaagaaatatgtagagaagtccaaagttgagaacatgtccgatgatgaaaggcaccttgccaatctcaatgctaaggccatgaacgccttaatctgtggtctttcccccaatgaatacaatagggtttccacgtgtgcaaccgcatacgaaatttggcaaaaattatgtgtcacacatgaaggaacaccccaagttaaggaatctaagattagtggactcatgcatgattatgagctatttaaaatgcttccaaatgaatccattgatgctatgttttcccgttttactaatatcatcaatgaattacatggtctagataagcaattatccattcaagagatgaactacaagatacttcgctcattgactccggcatgggagcccaaggctacggccattgaggaagctcatgacctcactaccttagctcttgatagccttatcggatgatagtctcatcggaaagctcaaagtgcatgagaagaagctcaaggggaaggagaaggaggaagtgccatcacgagaagttgaggagccgtcaccaaagttgaagaccatagctctcaaaggagctagtgacaactcatcttcgtcgtcggagagtgaagttgatttttctagagaagtggctcatctctctagaagaatctctagacttataaaaatgaacaaaaaatttaaccctcgatctaacaacaagttttcctctcgtgtaggtaaatgttttgagtgcaatgaaccgggtcacatcgctaaggattgccccaagctcaaagaaaagtacatgaagtacaagaagaagaaggctatgtatgccggatgggaagaatccgaaccaagtgactcggatagtgatgaagaaggagccaaacttgctcttcataacccaaatgtttgtttcatggcaaatgaagatgaggtaatatacagaagcgtgctcgctcaccaaacaagtcgtaagcatgagagaagaataaccaatcacacacgagcacaatccaaatacaacaaatcaaaccaaacacagagatatacgtggttcggcaatttgcctacgtccacggggagaggatggggagattccactaaatcaaacagagtacaaagggttacaatctcacaaaactcacaaactaaccctcaaccaaagctctcaacttgctcacaatatctccctctcacaatgctcaaaagtctctctaatctctgattacaactctcctctttttgattgatcctaatctcttctaaggcgttccatatatatagaaaacctaaaaccaaaacagactaagaatcctaaaaccaaaaacaaaacaaattaggaatcctaataacctattaccaaaacagattaagaatcatattaccaaaaaagattaggaatcctaataacctcatgttaccaaaatagattaggaatcctaataacctgttaccaaaatagattaggaccctgctatccaacaaataggttttgacatgtggctttggtcagctgtttttaaagaagcgtctatgatcaaatgccttagtgtgacacttgagggctcagagagtaagtgaaattcttcttgacttcggttttggaatacgagaagattctcaaacatgggataatgagaatggtccgttcttgtctgagtattatccgacccgatgtcaccacgtggaggaatcggagtaagagaatgcaaaactgcaaaggacaaatcaataaggttagcccaaacaagtaagataggtgggacattggctaaaaaaattcacccaaagaatggcacaagcctcatcagactggcgaactttgtttgacagatgaacctcatccatcaagacgaacctcgttaaatagatgaatgttgctagacagaccaacttcgtttgacagacgaacatcatccaacagacaagcctcgttagaaaagacgagactcatcagatcgacaagcctcgcctaacaaacaaatctcatccgtcaaacaagctttgtctcaaaaaaaaggaaactgttcatcttcctcgaagactcaagcctgaaataggcagagtttgatagttctaaaatgtaaaacttgcgttcgattgcaatacctgagaaaataggcaaagcgatgggagctagaggcccttttgcctttgcttttgccagcggtgatttttggggccatcagtgcgaagtcttgtgaaaaaatcaaaggcaaagaatctatgcagacgaagcacctagggttcaaatgtttgaagaagacgaaaaaaatttcgtcaaaggcggacgcttatttataggtagaaaaaaaatcaaatcagtggccgagatctacggccaagatctgtagatgaaatctgtaacagacaagatttgtagacgaaatccgcagaacaaatttcagagtgctagctggcgaccacctatcaggcctagaaaaggtgcgatgatggagaccattgcatttaatgctgacaaaatgaattgtcagaccaacatgggcctgacaaagctcatatggagtggtgagattcaacagaatgtcgagcctcgtttcgaagcgtccaagctcacctagaaatggcgaatcgcaaggttcattctgaagcgttgaagctaaccaagagagcaagttcatcatacgaaccaaactcatggtaatcagaaggggttcaaagtatttcagaccccatgcaacctaattcaggtctgaaaactttgaaggaggtcttgtaggcactaaaaaactaccaaaaatcaaaggagcatcaaagctcaccacaagcatgacgagggtcattactatgacaaacctcgtcttaaacaatgaagcttgtcattggagacaaagtccgaagctcgttaatgaagaaaaaactcaagctcgtcagtgaagataaaactcattattgaagacgaagctcgtcagtgaagacgaagctcgtcagtgaagacgaagttcatcagaagaagtccacaaggctcatcacgcaattggactcaaccattaaggatgaagctcgtcagtgaagacaaagctatttcaaaagacaaagttcatctcatagcaaagttcactctgttagacgaacctcgctgcgtatcaaggcttgtcttatcagaggaacctcacaatgcagtgaggcacgtcataccgtatgaagctagactataacggtcttgttgacctagtcagcccatgtgggctaaatttagggagtcagttatgccatgactccacgatttcagcgcatcagttacgagctaaggcctataagtagccatgatcaattatgaaggacatactttttttttctggccatggcttggcagagctcttgcactcgagcttgaagatccaaacctaggttcttgtggttaagaatcagtagtagctaccgacagcggctcaagtacttgaccatgcattcttgttctgataatcaatgggaagcaagctcgactcaagcatcgagtgaggcatcctttcgccacccagaatccatattaaacaaaggagaagtcgaaccaatcttctcctcttctataatcgactaaagagtgattgtaacgagactcttactaaccaatagagtattttctccaaagctaatacagttgaaggaatcaatcaatcattttttttacgacctacaaagtcatgtagtcggcggatgatgatgatgcttgtcctgcagcaagcaagcggctgatcttcccattggtgatgtagagagacccctcgcgtttgccgtatgctaccaccagggcacccttggacaccttccagcttccctgcttgaaggataatctgaaaccagagttagtcagtttcccgactgatataagattctacctgagatttggtacacgctgaacgttgttcagcgtcaaggtggtcccgccctccatcttgagggtacaattttcctttctggagaccttgcaaggttgatcatcaccaagatagactatccccaagtccttcttcatgaacgatgaaagcagcttttgttgtgaggttgcatggaaagatgcgccagagttgatgacccacacatcgttcttatcttcaagagatagaagaagtgcatccaaatttgtctcgtgcataaaattggctgcaccgtcagcctgatcatccctttctgatgctagaacaaaagctctgtagtcccctacaaagtgacccttctttccacatataaagcactttccttcaccgtaaccattcgggtccgaccctttaaactttcctctggactttgaccagcctcgtcatcccctacccttcttctgtgcacgccctcttgcctcgacatgcagagcactcccaatgctagaggtctcaactcctaagactttgcggcgagattcttcatctagaattgccccaatcaccgtgtcgagcttcatcttgtcattgccattggcattgctcaccgccatcaccatattctcccatgaatttggtagacaagaaagtagcagaagagcttggatcttattgttaaacttgagatccattgcagcaagctgttgcaccacagcctaaaattcgtttaagaagtccgctacgcgagctccttgctgcatctttagattgaatagcttcttcattaggtacaccttatttgaggcagacaacttctcatacaatgcctccaaggccttcatcaactccttagtggtggtcccatgcgagatgttgtaagtcacatgctggtgaaggttgagccttatggtgacaagtgaaattatcttagaggggggtgaatagggtaatgtgaaaataaatgtgcaattaaaatttgccaatgcaacacaccaatcaaattaaatgcaaaggtaataaatagagaaagagtttagagaatagttattgttgatgttaaatatcacacatccaattagatctaggctgggattgattctggtccggaactggatcggtctcctttgagtcctcaccgggacgtggtaagggagagtaatggaggggccactaccttcttcgactttattcctagttcttgaacaggggattgattttcatagtttataaaaaaaaggaggccgctttcttcttcgactttatgcctagttttagaattaggatggccgagcaatctgcacacaaaagagtcgtaagagggcagggaccggttcccccatggttccttcgacggtaaagttagtgaaacttgagtgggaaaagggaaggtcaggaaccaatatggttcttaaagtggcaatgtctctgccagaggatctacatgagctcctttgtctagacaaagaactgtgtgttcttgtttttctgccatgtatgcttttggggggttttaggttatgaacctcctctctccagctatggtgaatagcatctgtatataaataggatgttaagggtagattggtcaattcagtcatgaaaataatggtggcaaagtgtgagctggaaggtgagtcatctctcgctttacaggtgttgactgacgactggaggggaagtcacttcggcacaggagagggtgtctccacatttttcgggaagtgattgatggtgcggcagaaggcacgtgtgcatacttgaatcgtccctcgctttataggtgtcgactggcgactagaggagaagtcacttcggcacttgggcagctgacaagtcacatagatcattaggctaaaatctggataaggtttgtctgacatggattgaaatattaacatatgctctggggagaggctttaggcttgggccgagtctttaacttagtcgacagtagggaatgtccctcaagtcatctccgagaattacccagtgagtggtcgagtgctctaagtgggtcgccctcggtgatagggtcgactaatcccacctttcatgttggcataaaataaggtcgacttgatgagttggcgaggtcgaggcctccgttgggcttgggccactcaagtgggtttgaggttattttgttaggactcttattatatcattttgtaaatgcccatatcttgggtgagtgaacaccataacagttgcccctttcacttggagtcgacttttagtcagctctgagagaaataagatatgttctgatcaatacaagcctgctgaggacgaaaaaatgagaagtctttatcgagcatccattgttgactctgcttttcagagctgatgttatcaaagatctgaaccttctttttaggagatgaagtgtcgcggacataatggagcatctttcgcttttattgtaatgggacgtggggcattaaatgagggtgacgtttcatgttttgagtgaaccgcttcagattccgaagtggatcgggcctggttgcctcgaaaatcaccgcatcctttgaaattcctctatactcttccttgaaagcttataaatagcctcttaatgtcaagataattcttttacgaacctttgctttgacaaattcctaatattcctccaagattttttaagaaaaagtcttccatggcctctcaagtttcaaactctggccgtagtgaggagagactcgctgttcttctacttatcagctcgaaggtccatatggataatctgttggggttgtatgatcaatacaatatctctcaaactcttacattggtggcgccagagataagcgagccagtatattgccatggcgaggatcaagtgccgctatacctagcccacttggagcatggcttacggctgcccttgcacccttttattaaggaggtgcacactgctctaggagtctcccctttccagttctatccaaacacagtggggattctggtggctttcatcatcatttgccatcgtgttggagtccaaccaagcttgagattgcttgggcatttgatcggcgtggggtcagctgagaaggacccgcattactcctttcactatcatggtgaattccagcttgtctcaaattctttggagttggatgaggactagaggagcaatttgtgtgggtctatggtggcgacaatgtcttcgcctgctcgggctggccggaggcgaatgaagacgcgttgaggctagtcacccttagtgattccgagataatggttctggacaaggtctgttttttatgctgtaccatgagagagcgatgatctatttgatgatgtgtctctccaaacggtgggcatatctatgattttgtcttccactggcttccaagcaaggacgagccccgttcctctgttggcagaaagtcacaagaggaatgcagggaccgaggagttgagttccacttctaggcaccataaaaagctgagggaggccttcagtgctgaggaggtggctgtcttgatgcctcaagccactaaaattgtctttgaattaaggaggaggacaaatgtcgagagatggcgcccaatcggaccgattgggaagctccaaccaactgggatcggttcactggtaaattagcttaaccgcttggagaatatggggtggatagatgagtcttctcctgacagggagataacagccttagcggtcgaggaggatgtcgtcggccctagtactattcctaaggcgtctcgtcgtcctaaaaaggagctgattgggatggacaatagtgttgagaggagagctgaaactccgtcagaccagatggacaatggtactgacgggaggattttggaggatatgctaagtgttggcatacaccaagctctcgaggtttgtttggcttgggggactttgctggagtgcaccttatttaatcgacttgagcgttccttggaatgtcaagtaggcttggctaaggagaagtcgcccaaggaagaggcaacgaagaggatcactatcttggagaccgagttagctcacaaagaaggcgtttggtgccggagtctggatgagaaggaagagctccttaagagctttcgaatccagttctccaagttggtggagaccatcaagaaccttcaaagagagatggttcatctacaggcagaggttgagtctgagatagtcgtaggatgacagctgagacagaggctcaatcaagtcgcctatctctcgagaagatgagaagggactttgaagagatacaatcaaagcttcgggcgtccacagccctcgtccagaaactagagaaaaaaaatcatttatctagattcagagcagcataaaaagaaggtggtcgacaactgacatcatggttctatatggaaagccgagatggccctagcatgtaaggccggagtcgattactttgcttctttagtgcctcgcaactctcatcctacttcagattgcttctatcctccccgtgtttcctgctatctcgatttgttaaaagatgtcgagaaaaatggaggcgggttggatttatcaacgagtgatgatgaggtcgaacctattgctggggctcctagggaatcttctgcaactgccaccacccgaataccgccaagtctaactcccaaatctggtcgagagctttgaagacccgtatctcttcaatttttttattgtagagaagtttgtaatgaagtttactcttattgaatgaaaattaacttttgtctccattcttgagcttgccttcattatttatattcttttagctttgtaactttgtttttgtttgaaatattggctgaagcgagttagttgtaatgtgtcgacccatactggggacttatgacaactagttcatctgatgccttagtttggctgagtgtttaattgaccagaacttgacagatgagtgcttaagtttttagatcaattaagtattggccatacacttaatattcataccttaggcttatgaatactttttttggcagaatgacaaccctgaggttgggtgcctaggtcttacgtaggtgcctaagtcttcataatcctagtattgtcgaatgctgactgtgggattcgatcgtagggttgtgccttgggtttattcctgataaggtaccaaggacatgaaaatacaactcggaagtcgaacgcctaggctcgagagagtcgactaggtctttccttcccctaaggctgagagacgaccgtgggagtcagcaaaagggttgtgccttgggtttaatcctgataagataccaagggcttgtaatccaactcagaaatcgaatgcctaggctcgagagagtcgactaggtctttcattcccctaagaccgagagatgactatgggagtcggccaaagggttatgtcttgggtttattcctaataaggtaccaagagcttgtaatccgactccgaagttgaacgcctaggctcgagagagtcgactaggtctttctttcccctaaggctgtgagacgactatgggagtcggccaaagggttgtgccttgggtttattcctgataaggtaccaagggcttgttgggagtgcttaggtctttagccataatgaagccttaatccctacgaaatatgagttaattcatattcaataagatttcaccaattctaaaatttacatgatcatgaaaaatatcttttgtaggtatctggtgcccaaaaagggggttgaaccacttgtggtcttgctttgtcttttttttcacaaaggcagtgttgtaatggatgaggctgccaatatagaacctctctagttggattttgcttgcttttttttcttttttatagcggactgctcaatgatagatgaagatgagtcgaaactccatttgccatctcattagccaaggttccttttgagtctgaatcttcagtacggccttgaaggcggatggttagtatgccggattttagcaaaaggaactacccagacaccacgaatcatgttgaatgatgttttctaagtctggttcacgagggttgggggcacgatcggaagctatatggtaccttttgtggtagaaattctcttggagagagaatccaccagccgatattgtactccctgaaaatgacaaaccatatcggtttcctcgaatgagctttaggagtaccggggactggagcatgatgtaaatagagaactctcccttatggggatcatgaggatcatacgggtcacatgctttgaccaccagagcttaggtaaatttagtggtgcaggcgtcaattgaagaaccaatgtcattcttcttgagaagacaatcagctgacaggccctaagtttttcccacaatctcatccctgatgtataagagttcctttcaaaaagtcctcatggtccaaggcgcctatcacagacttaatcactgctcctatgctcatatgagctattgacagttagagcttaagtaatatttggcctgatcaaattctatgttttggctaaagttattctgtgatggcgattagaagccaatgttgcttttcaagaaagacaaccacccttatggtgtgtcttcttctggagggttttcagaggggctagaggtcattctaccatctagcagatggtatgcttattggcctctttgttttgatgatgtttaacaaataatctaccactaatattgtttgtctagtgtttgtgtttatctatttattataaacaaacatcatgttggaggatgaatggaatcaagctttcacgatcatatccaatggaggttggcggaatcgtgggatgaagctacgcaattcaagttaaagattcaagttcaagcttcatccgtaagtgtaccaagtcaagcttattgaagacctatagcttgggtaatctagtttaggagtttatattatgtgtgttaagtattttaagctcaatcatatatacacacacattttattggtttctttgtatagttatatatatacatatatattttggtttaatagttttcaagttttaatatgaaacaattgaatacaattgaaaatacatttattatttcatacttatatgcatatatatgatttcatcaatatcaattttatttagtttaatgaaatcatatttattgtttttgaaaagtttgcaaaatatgcaattttataaaaattttgtattctcagtttttagacttaacaataaacatatacatcttttattaagtctaaaaaatcattttataatgtttcaaaacatggttaagctaaaatatcaaaactcatgtgtttacacttttatgttttggactattttgaaaaatgatgatatttttcatttgagaggtcctttttaaaaacaaatttttgtaacatgtttattattatgtttacaatcatttcccaaagttttacatttttttgattttatttgctatttttaaaagatgtttgaaaattagatttctgtttaaaacagactgtgtgcatgtcttgagtcgactcatgaacagtgttgagtcgactaataaactgtcgtgtagtttacattttgtttctaacgagtcgactcacaacatcataagtcgacccatcaggttgagtcgactcatgcctgttataagtcgacttctatctctaaccctcatggcaggttaaaggccgtgtgagcgagatgagtccacgattttaatttctttgttttgttatgcaacccgagagggggcgccagctgttggggagcctgaacctaaaccaatcctcatctctgatgacgaactagaggaagctgtgaccgcatccgatttgcagtcttctcctcagccagaaacagggttttccccaagatcccgcttttcacaacacttgcccgcggtcaggagcctacttctttaggctccctctccctacaggctcaccttaatgaattggagaacattgcaaagtaagtgatctccatcgtcggccttggttgggggacttatgcgaatttcagacaatctctcctagaccatgtggctgacgttaggcagttgggaactctcgtcgtagagtttgatcaagctaagtacgaggaagccttatcctcaggatcgcttagccccaaggctaagcacgatgtccgcgagacctccaagaaggtcaattctgttgtcgaagtgccgaagaaagccctctccttcggccaagaactcaaactggctctgctggcggaagatcccacatccgcgtcagcaagacgttcttcaggccacaaacggcctctggaggaaacgagttccataagcgtcaacgacgctgctgctaaggctttgaaacaagccaagaagaacgccgctcgccgacggagaagatccatacgacgagcacatctacgtgaaagctgactgttggcccaacgcgaagatcgcgtttctgaaaatccaacagagcctagcgttcccaaaggagaacgctcacttcgcggcaacgagcccaactatgaacctcgcctcatacagctgaaatgcgaccctgaatagcgcgttgtttcttcaaaacgcagccctcagaggagggctgccaaaaccaaacgcgacccccaggggcgcgttccaataaatcatgactctcgggagtctgtttcatcaattaaacacgaccctcaggggagcgtccaacataaacacgaccctcaggggagcgttcaacctaaacgcgacccttaggggagcgttcaacctaaacgcgaccctcaggggaacgttcaacctaaacgcgaccctcaggggagcgttcaacctaaacgcgaccctcaggggcgcgttcaacctaaacatgaccctcatgggtcagtttcatcatttaaacgtaggcctcggcctaatgttttcaaagctaagcgcgaccctcgcgttatccttcaagaacgcgatttccaagaggtccgccaggttcagaagaatcagcgtggcttcaaaatccacgttcaacgagaaccaatttcacctacccaagggcagggggttcaatctccgcctccaagcccagggaaagtttcctcccaagtttccgacctacgggaattgttgtcaagaggaaaaccaacaatacaagcagctcactcatgtcaatgtgagagactgatttcagcagtcctgtcagaatgcccttgttgtgcacccacaccacgacagtccgtattcgacaggttaacgaacgtcgttaggcctgccaaacgacaacgccgctacagaaagaagacagctgaagcggaataccctcaggtcactatcaatatgatcggccgagggaaagcttcacatactgactctgatgagtcgcaagagagtcatcccccgactatccgagaaatttgtgaccagttcgaatggataggagctattcgtccggttaactatcaaaagttagccaagggcattgcaacaagtgatgaacattcggcaatagccgaatctcaatcttcaagctctgttggagcacgcgaggtctccgcttacatgtcagggaatcacgaagacatcgccaaaagagtggacgaacatcatgtcatgctccaggcgcaacaagagacacttctccaattaaaggatatgctggctcagcttcttgctgaaaaaggccacaaacctgaatcttcccggagaacaacttcaaagggaaaacaaaaagtgcacgaacattcagatcgtgagactcacaacctgggatcctcttctgaaggtgagaaggagatggagaaagaactgcaccctcaatctactaaagtggatgagctggaggctcgccttaacgcaatcgccaaccgaagtgagctccgcgaagagggagtagtgcggccttaccctgctgagtgggatacagctccctacccaccgaaatttaaggcccctaccttacaaccgtttgatggcacaggatcgccaaatcagcacatctactacttcaagtcccaaacaggggatgtggtagcaaatgatgccatcctgacgcgcttgtttatcggcactcttaaaggtgttgctttcgaatggttcatgaaactgcccgctggatctatccagaaatgggtagacctggaaaggctattcttggccaggttctttgaggatgatacggaggtctcagtcccaactcttctcgccactaagcaaaggaaaggagagtccatcaaggcctatgtggagagattccgcagcatggcattacgatgcccctcaggtatgacccaatcaactctggttgaaacttgcaggcacaacctgcagacccagctccttgctcaaatgggggtggcagaatgtcgctcctggagacaactagtctcacaaggagaacaagctgaagaaatagtggcacgggtcaaagccgaagaaatgccacaacccaagccgcagcagcaaaatcagcaacgcaaccagaacaacgcccaacggtctaaggggaaggagaccttggcggccgactacacgcgagtaccaccaccgaataagcaaggcaaggcgccaaatcagcaaagaacgcccaagcagtattcattcaaagaagagcatgtggataccttattccaattgcttcgaaagaacaacaagctgcaattgcctgagatcaggaagccggatgaagcagggaaagtggatgaccccaactattgtcgttatcacagattccttggacatcctaccaaaaagtgctatgtcttcaaagacatcttgcagaatttggtgaatgctaatgtactcaccttgaagccagagtagaagaccgtatcaactaatatgatagcggtccaattcggtgactttcccccagtggtaacagcgaacggcgtcatccccattcgcaagggagaaatgcacctgaagaatgttgacccgcatagtcagaaagacagggggttagtgcctctcactacccaaaaaggggaaatcatgtgggtccatcctgatctgctaagagatcaacaatggacaagcaccccgtccaaaaagaagggaggcaaggctaagtcttccaacatgattagcccctccattactgaaaataatgaacctcagacctcttactgattcagaagaagagaggattgttctagcagcatacccagaaggcaatcctggcactcggtcaggaaaagcttacttgagggattacggccagaatgctccagaagttgaagagcagccccaagacgctgggggttctgccccaaaaaagccagtggacaaaggaaaacagaaggagctccgattcaacagaaatctccaccaagaatctggagagtcgagtgctcccttccaattcaacgtcatggcgcagctggccaacataccggccagaattacgctatatgagctcctaaggttatccaaatccaccaaggaagctctaattaaagctttgaagaatacggagagcttcattactcaagtaactccgactcccgaagcctttgaagatcaactttgtctgcaatgcctacaagcagcgcgaagtctaccatgcatatcattcacgcaggaagacatgcaggtcaaacacgaacatgaccgaccactatactacacagggtatattggatcctctgaaatcagtcgtgttcaggttgacccaggctcagcgctcagcatcatgccttacagggtcatgcaggtcttagggattcctatgcaccgactgcacaccacccagactactatcttcgggttcaatgcaaacagtacccgacccctgggaaagatcaagctcagatgccagattggagatcttaagtctgaagtagcatgctacatcatagatgcagacacgtcctacaatcttttgctaggacgaccatggatacatgcaaaccgcattgtcccatctactctgcaccaggtcatgaagtacgccaatgacgagggcgaagtccgaaccttgattgcagaaaaataccccttccgaggggtggaaaacttccataccgactccgtcttctattcggaatcccaagagaaagaagatgtagacagcggtaatgaggctgacattgagccagatcccgatgaagattgtccttgggaattaaattttgatgtaatgggtcagggtgagagtaataatgatgtaccgagtgagggcgagtggtgcattaataaagatttcattttagcgtacttgtctgatgtctctcctgaaaatgaacaaatagagaataattctagtgcaggtaccaacccatggcacatactgtgcacagaggcgtcgcttaccttgccaattcagtcatccttcgcttcagatgaagaagtggaggacgcacagaaggctttcttcaaagtctcatccaaaaggaaagggcaaaagccgatctgttttggtaaggtcaaacccgaaccactccgacggggaagctcggaagaagatgatggagttccccaattccattaccatgaacccaattctatatacttaatgaaactaatggggtataattttaatgagaaacagggccttaacttcgggaaaggaaggcgaacgccgatccgaatgtctctcactcctgaaggaaaacctccggactattatcaaaaaaccggaagaggcatgggttacgttacacctccccccgcttcggaaaacgaaatcagtaattacctgcgtcacgaccattcatctggaacatcttcatacgagtccgacgtcagtgttggacctttctttaaaagcttgactgtgaacatggtttcaactagtcatccagatgaagacgcatgggggtgacgaggagttgatggaatcgaccaatgatccttggatcaaacgtctcaatatcttgtgggatatgcgattcgaacaacgcgaaccacccactgaagataaagtgatccaggtcaacatgggagatgaacatgatcctaagcccatattcatagctgaagacttgtcatcatccgaaaaagaggaccttatatctctcatccgagaatatatagatgtcttcgcttggaattatgaagatatgcctggccttgacccgaaggttgccatgcaccgtctcaacattgatccggacgcaaaacccgttaaacaacaacaacgtaggtttcgtccagagatcatggaatcaatcgagtcagaagttaaaaagcttatagactcaggttttgttagagaagaacaacacccagactgggtggccaacattgttccagttcccaaaaagaatggtaaggtccggatatgcatcgatttccgcgatctcaatgccgcttgtccgaaagacgaattcccgcttcctatcacggatgttatgattgacaacacctgcggatatgaaaggatgtctttcatggacggattctccgggtacaatcagatcaagatgcacccggacgacaaaaagcatactgcttttagaacaccgctgggggtatattgctacacagtgatgcccttcggcctgaagaatgcaggtgcaacttatcaacgtgcaatgaacacaatctttcacgaacacctacgaaagaagatcgagtgctacgttgataacatagcggtaaagagccaatgcaaagacgatcatcttgcagatctgaagacaatgttcgaaatcatgcgagcacatcagctgaagatgaatccgacaaaatcatttctcggagtttcaagcggaaaattcctaggatttatcgttacttccaaggggatctcccttgatccagagaaagtgcgtgccatccaagacatgccacctccgaagaatctcaaagagctcagaggtttgcaaggcagactggcctacattcgaagattcatctcaaatctttcagggcgttgccaacctttctctaaactcatgaagaaaggaatatcctttgtttgggatgcagagtgtcaaagagcattcaaggagattaagagatatctaactcaaccgccagttctcgtggccccgatatcaggaaaaccattcctgttatatgtgagggccatggatcattctcttggtgctttgttggcccaaaacaatgatcaaggtcaagagcaagccatctattacctgagcaggactatgatgggagccgaacatcggtacaatccggtcgaaaaagagtgtctcgccttggtattcgcaatccaaaagatgcgacattacctagttggacagaccattcaggtcatctctaaggtaaatcctttgagagttctgatgacaaaaccatcatctctaaattgccggcttgcaaaatgggccattctcttgtcgcaatacgacatgcagttcatgcctcaaaaggcggtcaagggccaagcactggcagacttcttagccgatcatccagtatcaggagcatctaagttgtacgaggaattacctgacgaggttgctgaagcttgcgctacccaagaagctacgcaagtgtggaagctattcttcgacggtgcatccagagcaaatcctcatggagcaatcactgcgggagtaggagtagtgttaatctctccgaacggccacgtaatcccaaggggattctctttaatcgaaccatgcaccaacaatgtagccgagtataatgctctgctattaggaatgcaatgtgctgaagaacttaatgttcagcaccttgaggcttacggtgattctcagctcatcgttaatcaagtccgaggagagtacgaagtacgtcatgaggatttgattccgtattacttcgcggtgctagagcaagctcaaaagtttgaaggcttctttattgaatatgtgccaagagctcagaatgcatatgctgatgccttagcctctttggcaacttcactagccttgccaccaggagtggaagcgacgatcccggtcatgggacgtaagctgtgcttttccaagatctccatagaggaaaacccagacgagatgacgtcgggagaagtctgtacggcatttatggaattcgaatctagggattggcgattcccatacatcgactatgccctatatggaattctacccgatgaccctaaggaagcggctgccatcaaacggaaggccctccaattctattatgatgcagtttctcaagtcttgtatcgtaaatcacatgatggaatcttacttcgatgcctttctcggaaggaagcgaaagaggccctcaaggaagctcacggcggaatgtgcggagctcatcaacctggagctaaattaggagatcgactccgacgaatcggctattattggccgaggatgttttcagacgcggttgactacgctaaacgttgtcacgcatgccaaattcatggagattttattcaccaagcaccggggaacttacaccccacatcggcgacttggccattcgaaatgtggggcatggatatcgtcggaccgatctcccctccgacgtccaaaggacaccggttcattctagccgtgaccgactatttctccaagtgggcggaggcaatcccgttaaaagaagtcaagacttcaaacgtgatcaagttcatcaaacatcacgtcatctatcgttttggagtcccaagacgaatagttcacgacaacgggacacaattcgtcagctttgggtttcagagattttgtgataaattcagaatccaaagtgttgcatctacggcgtattacccaccagcaaatggtcttgcagaagctttcaacaaaaccatagtgaagcttctcaaaaagtttgtttccaagagccggcgcgattgggatgaaagactcggtgaatgcctgtgggcttaccgcacaacagtgaggacccctacaagagctacaccattctctttggtatatggctgcgaggctgtactgccattggaaattcagatcccttctctgagagttgctatcacaactggactaacagaagaagaaaaacatcaacgacgtctgcaagaacttgaagctctagatgacaaacgacttcaagcgcagcaacagattgagctgtatcaagcccgtatttccaaggcctacaacaaaaaggtcaaggaacggattttcaggaaaggcgatctagttttggccaacagacgacccatggtaatgacccacaaaaccaaagggaagttcaatcccaaatgggaggggcccttcgtaatagaatcagtctattcgaatggagcttatcgtctcatcaatcaaaaaggagataggctcatgatgccaatcaatgggaagttccttaagagatacttcccataaatcatgtagccccctgaaccccagctaaatcaggctgggggttgcctatttataatgtaaccctgtcttgtatttcgtcatgttaacattacacctctgacgattgaaatttgctagaatcggtataataaagaaaatttcaatttcatgccaggttaacactatacttatggcatttgctttacttttcattgtcctgaaccagatttcaacaaaagagatgatgagagccaaaatgatatcattttcattcaatatttttgatttgaatacaaaatgaatcgaaacgaaaatgatacaaaattattcctagctaaaaagcaatccaagtcctaaacatcggagctcatcagtctaaaagacttgagtttagctttcagcgccaatattttctcctcacgagcctttttgacttcctctgttatcttgctcttgagctcctcttcatttggcgctgcttctgcaatctcccgcctaactttgtcagcagcaacaagctcatcacaatagcccttgaaaagcccgtcacaataagcaattaacccttttatgacttccatgtcgcccgctaatcgagcagttatctgagcttgctcgataccagcacgggtaagctcaatcgcagtatcccgaatacctgcagcaaaagtgcccaagtccacttgcacttgaagatgttccccgcgcaggcgagtaatacgagaatctgcttcgtttagactcttctgaagagcttcttgctgctgtaccttcaaggctctggcctgagaaagagcccgatccacttctggttcgatggcatcgcgttgtagcattgaaaggaattccaattcgtattccagaacaataatgctctcgcgacaatgttcagtccacgatgaaaagaaagggcagaagccgatctgttttggtaaagtcaaacccgaacaactcaaacgagcaagttcagaggaagacgacggagttccccaattccattaccatgaacccaattctatatacttaatgaaacgaatggggtataattttaatgagaaacagggtctgaacttcgggaagggcaggcgaaccccagtccgaatgtctctagcccctgaaggaaaacctcaggattattacaataaaaccggaagaggtttaggttaggaaaacgaaatcagtaattacttacgtcatgaccagtcatccggaatatcgtcatacgagtccgacgtcagcattggacccttctttaaaaacttgactgtgaacatggtttcaacaagtcatccagacgaagacgcagggggtgacgaggaattattggaatcgactgatgatccttggatcaagcgtctcaatatcctgtgggatatgcgcttcgaacaacgcgaaccacccactgaagataaagtgatccaagtcaacatgggagatgagtctgaccccaagcccatttttatagccgaagacctatcatccaccgagaaggaagaccttatatctctcatccgagaatatataaagataaagtgatccaggtcaacatgggagatgaatctgatcccaagcctatctttatagctgaagacctatcatcatccgagaaggaagaccttatatctctcatccgagaatatatagacgtcttcgcttggaactatgaagatatgtctggcattgacccgaaggttgccatgcaccgtctcaatattgatccggacgcaaaacccgttaaacaacaacaacgcaggtttcgtccagagatcatggaatcaattgagtcagaagttaaaaagcttatagactcaggttttgttagggaagaacaacacccagactgggtggccaacattgtcccagttcccaagaagaacggtaaggtccggatatgcattgatttccgcgatcttaacgcagcctgtccaaaagacgagtttcctcttcctatcactgatgtcatgatcgacaatacttgcggatatgaaaggatgtcttttatggacggattctccgggtataatcagatcaagatgcacccggacgacgaaaagcatactgcttttagaacaccgctgggggtatattgttacacagtgatgcccttcggcctgaagaatgcaggtgcaacttatcaacgtgcaatgaacacaatctttcacgaacacctccgaaagaagatcgaatgctacgttgatgatatagcggtaaagagccaatgtaaaggtgatcatcttacagatctgaagataatgttcgagatcatgcgagcacatcagctgaagatgaacccgacaaaatcattcctcggagtctcaagtggaaaattcctaggatttatcgttacttccaggggaatctctcttgatccagagaaagtgcgcgccatccaagacatgccacctccgaagaatctcaaagagctcagaggtttgcaaggtagactggcctacattcgaagatttatatcaaatctgtcagggcgctgccaacctttctctaagcttatgaagaaaggaatatcctttgtttgggatgcggaatgtcaaagagcattcgaggagattaagaaatatctaactcaaccgccagttctcgtggccccgatatcaggaaaaccattcctgttatatgtgagggccatggatcattctcttagtgctttgttagcccagaacaatgatcaaggtcaagaacaagccatctattacctgagcaggattatgatgggagccgaacatcggtacaatccggtcgaaaagaaatgtctcgccttggtattcgccattcaaaagatacgacattacctagttggacagacaattcaggtcatctctaaggtgaatcccttaagagtgctgatgacgaaaccagcatctctgaattgccggcttgcaaaatgggccattctcttgtcgcagtacgacatgcagttcatgccccaaaaggcggtcaaggaccaagcactggcagacttcttagccgatcatccagtatcaggagcatctaagttgtacgaggaattacctgacgaggttgctgaagcttgcgctacccaagaagctacgcaagtgtggaagctattcttcgacggtgcatccagagcaaaagtagtattaatctctccgaacggccatgtaattcccagaggattctccttaatcgaaccttgcaccaataatgtagccgagtataatgctctgctaatgggaatgcaattatctgaagaactcaatattcagcatcttgaggcctacggtgactctcaactcattgttaaccaagtccggggggaatacgaagtacgtcacgaggatctaatcccgtattacttcgcggtgctaaagcaagctcaaaagttcaaaggtttctttatcgaatatataccacgagctcagaatgcgtatgcagatgctttagcctctttggcaacttcattagcattgccaccgggggttgaaacaacgattccagtcgcgggatggaaattatgctcttccaagatccccatgaaggaaaacccagacgagacgacgtcagaagaagtctgtacaacttctatggagtttgaatccagagattggcgattcccgtatatcgactatgccgtatggaattctgccagatgaccctaaagaagcggcctctatcaaacgaaaggccctccgattttattatgatgcagtctctcaagtcctgtatcgtaaatcgcatgatggaattttgcttcgatgtctctcccggaaagaagcaaaagaggccctcaaggaagctcatggcgtaaagtgcggagctcatcagcctggagctaaattaggagatcgactccgacgaatcggctattattggccgatccgacgcatcggctattattggccgaagatgttttcagacgcggttgattacgctaaacgttgtcacgcgtgccaaattcatggagacttcatccaccaagcgccagggaacttacaccccacatcagcaacttggccattcgaaatgtggggtatggatatcgtcggcccgatttcccctccgacgtccaagggacaccggttcattttagccgtaaccgactatttctccaaatgggcggaggcaatcccattgaaagaagtcaagacttcaaatgtaatcaagttcatcaggcatcacgtcgtctaccgttttggagtcccgaggcgaatagttcacgacaacgggacacaattcgtcagctttgggttttagagattctgtgacaaatttagaatccaaagtgttgcatccacggcatattatccaccagcgaatggtcttgcagaagcttttaacaaaaccatagtgaagcttctcaaaaagtttgtttctaaaagccggcgcgattgggatgaaagactgggtgaatgtctttgggcttaccgcactacggtaaggacctctacaagagccacaactttttctttggtatacggcggtgaagctgtattgccattggaaatccagatcccttctctgagaatcgctatcacaactggactaacagaagaagaaaagcatcaacgacgtctgcaagaacttgaagccttagacgacaagcgacttcaagctcaacaacagatcgagttataccaagcccgtatctctaaagcctataacagaaaggttaaggaacggattttcaagaaaggcgatttagttttagccaacagacgacccatggtgatgacacacaaaaccaaagggaagttcaatcctaaatgggaagggcccttcgtaatagaatcagtctattcgaacggagcatatcgcctcatcaaccaagaaggagataggctcatgatgccaattaatgggaagttccttaagagatatttcccgtaaatcatgtagccccctaaaccccaaccaaatcaggctgggggttgcctattcatagtgtaattctatcttgtatttcgtcatgttaacactacacctctgacgattgtaatttgatggaattattctaaataaataataaaaggggatttcgataacatttgcattattttctattgtcttgaaccagatttcaacaaaaagagacgataaagagcaaaagtgatatcattttcattcgatgtggttaatccaaacacaaaatgaaaaagatacaaaattccttaatcaaaaacaggtcaagagctaaacatcaggcttcattaacttgagggtttttagcctagacttgaaggcagagagtttctcccggtgagccgctcgaacttgttcctcgatctcctttctgagttctgcttcaataggaagagtagcaacaatgtccttacgagtctgctcagctgcgtggagtgtacggcaaaatttcgtataaatttggccacttttatgctcaagctcttttctgacatcctcatagtgggccaattgagctttcttctggtccaactcggcctctaatcgagcgatagtctcttcaatatcacgaatatcagaagcaacacgtttgattttagcatatgctttagagtgtcgcttccttaaagttgatatacgggctattttatcagatagttccttgcgaagattccctgggtgatgcgctctcgagattatcgccaaggaaagagccggctccacttcagaatctaaattggcgcgctgtaactccctgaaagctgtcaattctgccatcaaaagagtgatcccaccctggcagtgctcagtccaggatgcatcccctttggccttgatgtcgtccaaacattggctcaagatggatttacagtcttcaagagaagccccctcaacactgatcataccaataattgtttgcatccaacgttccagttcatcaattgatttcttcagagctcctgagcgtggaggaggaagagttggatagattggatccgtatgatcatcctgaacaggtgttggagcaacttcagaagaaggaccctcttcagccccatcgtcttcaggaactgaggggatcgattgaggcatttcgtcctctccgtcagtagaacgctcaacgagcgcagacttcatcgcatcccccattattttggccctcttggaattcttggccatgacaggtatccgcttacggattctcctgtcatactcaccttgctcagcagcagaaagagcttccttacccgatcttaaagaacgaggtgtaggaacgggctcttctgcagggatctcctcagtggtcttttcttcaggagaatcatcaattggctttccctcttcaattcccgtaggaacctcttcttcagaaggttctacggtggacaagtctttaggagcttcaacggctccggtcgcttcctgttcacaagataggtattcttccatccctggtagacgagtactcgcagaaccgctccgtgaacgatacaattcccgaatctcgtttatacatgaagtataaacgtcatactccggaatctgagaagcttcggcaaaccactggcggaaatccataacagcagagcagccgggtgatgaatggggtaaagtgaattgcgcatgggttcccccggcagagaaaaagtaccatgcgcgagctccttcgcataaattcccaatctgagctaacgccgggttaggattgccaacatagagttacagcagaaaacccggtaattatcttcccgggatagaagctgtcgagccctgactatataagaactagtccacgtggccgactccaacctttgtacgaagggagtataagcatcatccccttcatgcactcccgtcatcaaggaagggcaatgcaacacgaaccaggccactaaatatgtatatggcattggtacacgtggttgaggagccttcccagctttcttcttagtagctttgactcccgaagcactgagaagttctgaagtcaataccctcaggccgttctggatacagccaaccatagcagtaaggagactcacaggtctcccatgcgctaggaaaacagctgggtacacaacctcagccaatattgattctattggtcttgacggtaccacacaccgcttcaaccaaatcatgaagaagcctgcaagtagagacgtgtcagagataggaactgtggcttggtagtgaaaactttcaaactcggcaccagcttcaaaatcatcctctgcatgctctgtcttataggtagcactggaagctgtaattcgagctttggcatccttacgaatctttccgatttaagttttgaaagaggtagtctgcccatgtggtatgcataataccccctccacgcatcccaaagacttgggcacatatgtggaagtggcacatcaattcccaaaaagtagcataaatttccgggtgtgccaccttcagtaaggaaagctcctcggtggtagggataaacccctcgtagggcgtttttccaagtgacagccccgacactgcctgcatttcatgaagagcaaaacctaactctccagcaggcgtgaagaatgtgcagctgtcaggattatatttctccaacatagcgaagaagttgtgaaggctctgcacgactccccgtcgtgtagctaacacaggaactgtgagacccgatcgggtccaccaacctccttctagagaacagacccatccaggggacctgaacgtctgggtagagaattcaccctgagttgcaaggaattggcggataaaaatgttcgctggacgtggcacctccgaaaccagctctttcttctcaaacaaaccaggttttaaccccttgagttgttccccgatttctgtacgagcccgtcgaccaaatccaagcgacacgttctccttctcctttactatgtcgaaggtcaaaccccgacggcagctcatattcaaaaagtaggagagagggtacatcctcttcatgtttgggagaaataaaaagcgattatcagttctctgcagcagcttcgaatcttctacatatgtgagatggtcatcgactggtatgcgatctccaaatatgaatgctggtttgggaaactgggcatgaccaacaggggtctccaagtccaagtcagttatcaaaatcctgagagtagagcattgagggaatttaatcatttccgctctttccgaatcaagaaaagtacacaatggaatcctgttctgaagactgaataattcattcgggtcaggtccaccaatatatccgaaatggtgctcttgtgaaagcggcacgtttgggagaagcactgcacctcgtgtcagaaatctccaacgcgaaggtcgaacctcgtgtcagaaatctccaacgcgaaggtcgaacctcgcgtcagaagtctcaaacgcgaaggtcaacctcgcgttgaaaaacttgaacgcgagggtcgagacccacatgggatcccaaccccgcgttttcattgagttgaaacgagtcatcttcctcgttatcaagaacccatctagggttttcaaagaacttgccaaggcaagttatttcggtcagcactcaccacgacagggaggcccctgcggcggcgatgtcgatggcaaggttcctgcatggacaagagcaccgccggcgttctcagccgacggcatgtcggaagttgctccagcgaccttcttggagttcgaacccgtcctccgaggcgccattgatgcagtcgatcgaaagaaactcctttgaacgagggagacgaagcttgtcggagatctcgccatagtcaaacgagagttctcgttcttggaaatagccgaaagttttgaaagtcaagtgacttttgatgtgaccattcaggtctatttataacagccgccaagctgttaagatggtacaggattctaggagtgaatcccaaccatcttcaaaacgcgaagctcactatcgcgttcaatttcccgagtgcaaagctcaggctagcgccacgaaggcccgaacctcgcgttctgaatcccaaacgcgaaggtcacttcagcgttataattcttctaaatgaagaatctacatttgtgtcatcaaacacaacacttatccctcaaagtcatgagccctcttaacagagagttagtcaaaacctctgtatctcatcagcagaatctaaattctcatcgggctaatattgcaccccagaatccacttatcaattctcattaatagaatgataagtctccaactcattgtcaatttattagctctcctcagcagagcaataaataacctgcttccagcgggttaacaaaattccccaaaaccttgtccaaatcacaagtatcacaattcatcgctccgatggtaaaacacttagcagttctccccagtgagatgctataatatccttcccccacagttgtcacgttaaaattgcacctctgacaaaatcaacttatcgattctcatcaatagagcgataagtcctcaaaattgccctgatcgcaatattccagttgtcacgttaaaatcacacctctgacaaaatcaacttatcgattctcatcaatagagcgataagtcctcaaaattgccctgatcgtaatatcccagttgtcacgttaagattacacctctgacaatatcaataatccccatgccaagttgaaactatacctctggtacttatagatttctttcagtgttcaaagcaagaaataacataggaagaaatctactagtcaaccccattatgggaatattcatcctcagcagtttaaaactttctagagttattttaaacgataataaagagagttttctgcaccagaaccattgtggagatctattctaagtcaggaatacatcccaggcatttctcatgacttgtatttaaaattaaaacataataaatgcaagaaacaatgagaagtcaatatcactttttattcagaaaccaaaaagaagtgatacaaagctgttcttaagcaaaagaatagtacgagttcaagtcaaaagaagcaagttgagctttggcatcagagagcttctcctcatgattggctcgcacaaaggcttcagcttttttccgcagctcatcctcactgggtgccacttcagcggctgcctccttcttcgctctttcaagagcctgagcttccttacggtagttcaaaagagtgtctgcattcttggccccaagggtgttaacaacggcttcttctcgagaaagctcggccttcaaccttaacacctccgcctcagcttcgacaagtttcgtgcaaatgaggtccaaagaagcagttgagagttccagttctttttgtctcagatcgctctgttcccgcaactgcgtaacttgaagctctttttcagccaggcctcgctcaattgcctcacggcgagtcacttcctcaacctggaagtcagcaaaagtagacacgatctgtgtatgaatgtcttcatggctgtgggcttccaaatgtttgagtcgggcttctaagtgggaaatggcttccgaacaacgttcaaagcaatgagcattgcccacacttttgaccccatttaagcctgcttctaaaagagacttaaaggagtcaaagcggcctcgaccagctgtgacaacctcaatcaccttccgcacgagactgtttaagtagctcaaggacatatggaggaagtcaggagcgtccgttggactagaaaaagcaatggaagatgactctacaaccccagaagttgacatgctaaaatatggattggcaagtgatttgggtgtagaagtcgcggaggcaactaaaatattcaattgcgaagggcttgaagtcaaggccatcattgccctcgccggagattcgcttggtccggcctctgtgggcgcaagcgagatcttcatcaatgctgaagatgaagcagctacggtggatgaggcaggcaggggctgctcttgcatagaagctgacgcctgcacgagctgctgttccggtggaggagttgcagtagtagtttcaggcaacgctaaatgttgctcttctaaaggagccgacacctgagcaggttctggctcggaagcagcagcagcagtagtccttggagaaggtgaacctgcacgaaaaaatggtcggaacgtggagaaagcatgtggaagaagtcgaaacaaaccaagcttaccgctaagatagaaaggagtataaccagatgctttatcggatgggaccttgggagcgtcatcatcaaaagtggtgacgtcatctatggaatcatgctcttcgtcatcttcaccaccacctgacatgttgccaacgtcagcgtcctcatcatctctatcttcgtcagctgcaccaccaatcgaggagtcttcataatcaactcgctcctcatcatcccgggtagctgagggctcagggagacttgcacctgcagctggtcttttcataggtcccgttgtaggactaggcattaaatcaccagcttgtgacattaatgctgaaggagaaggagatggattatcttcaagaccccctggttccaatgcaggagacctaggaagatccatcaccggagcagactctgcatctgcagccattaattcatcttcttcgtcctcaggaggatgataagaagaaacttcgcccgacagagctgggccatgagaacgaagtcccgctctgtgtggcaggccagccacagatgattcctgtggttcgtcatcttcagctgctttgatggcatcagccataaacttggacttttgttggcctttggggggagaatccaccagcagtttctgacggatctgcttatcatactggccggcttcatcagcagaaagttttcttttccccgctgctcttgtcacgggaggatcaaccactcgttgctcttcccctagagcaggctcagctgtctgttcctcttcttgtctagcagattgattctcgatggacagaaactcatcgatccctttcaagcgggatgtcttggaccccttccttaaattatacatatgcctaatgtctttcaggcaagatttattcaagttgtagttgggagtctgagaagcggcgtaataccaattacagaagctgatggaggtataggagttagcagttttgtggggaagcttgaagacggctttggtacagcctgctacagaataataccaggccctggctccttcatataagttggctataactgagagttgaggacgagggttcccgacatacaactgatcatacccaaattggcgagcaaacctatagggttggtaaggctcgacgaaacagttgacgccttgccgaaagatcaggtagcctggcctgatggatagaagccaatggaaaacacccctgctcagctgagtgaatccattaggacctgccgtatcctgatattctgccccatagacaccgccttcgaaatcagggaaacagcggtagatatggaagttggtgtctcgcgcaaggatttggcgaattctaaccatgtaaccccccacccatttcgcagattctagtcgctgcacaaatgggatgaaggagtcttccgggggagaggctgcactcatcaaagtaggacagtgaagcacgtaccaagccatcaaataggcatatggcattggtaccctgggattgggagttttgaaagtcttgtgaccctcagactccatctctgtaacaccaacaaagtcagaggccaactcccgcagtccatactgtaagcaacccaccatggcgctgaggaggctcacaggtctcccatgtgctaagagaacagctgggtagaccacctcaatagcaagggcatcgatcggcctggtaggaacgacgcaacgcttgagccacaacatcaagaatccagccagcaacgccgcgttggaaatgggaatcagagcttgataatgaaagctctcaaactctgtgtgagccgggaaaacatcttccttggcctcattggtgtaatgggggtagcgtcgtcaatacgagcctgaacctcttccaaagtactgacaggtaatcgggtcacagagcctcctttagtggtcaagttctggaataaatattctgcccaagacacttgtttgatgccgcttccgcgagcccccgttagctgcatgcagatatggaagtgacacatcacttcccagagagtggcgtaaatttctgggctggtcttcttcaaaagtttaagttccgtagatcccggaacaaattcttcatagggtaaatcccctagaataagacctgagacttcgtgcatctcgtgaagagcgaagcctaactcctccacaggggtgaagaaagtgcaagtctcgggactatacttctccaatatggaaaagaaatgaaagtggctctgaataatcccgaacttagtagcccacactggaatcagcaatccagcttgggcaagaggggtttccaattcctccagaacaaacttggtcatctgggcccaccaccctgacactggagaatgaacccaaccaggagctctaaatccttgtgcggggaattctcctttcttttccaaaaatctcttaacaaaggtcttcgctgggctgggtacttcaccaaggggatactccttagcaaataaactcggccgcaaagctgtcacctgccggttataaccaactgtgcggaccccgtgaaaagtcaaagtcccgagagcaaccccatcttgattcttaaccaggggccaatccatatgccttgggacagaagcacactggaaataagatatggggaacatcctctccatattgggcaagaaaaggttgcggtccccaactttccgcaaccacttatagtccccatcataagcagtgcttgcgtcgaagtcaacaaagtccccgaaaagatattcaggtttgactattggcttacggcttgggctttcaagtcgggcgtccgtaaccaatgtcctaagagtgtcagaagaagcttgggtaattatttctacgtgactcttctccctaattcggaaaacggggagttcttggcgtgagctgaaagcaatgttcatgtccgcaccaccttcatgcccaaaatggtggagaaaaagaaggggttcactggtatggcgcactgcaaaaggaagaagaaagttagataactcaaaagcaagactcagacgggagggtcgaaccccgcgtcagataagttcagacgcgagggtcgaaccccgcgtcagataagttcagacgcgagggtcgaaccccgcgtcagataagttcagacgcgaaggacgaaccccacgtcagataagttcagacgcgaaggacgaaccccgcgtcagataagttcagacgcgaaggccgaaccccacgtcagataagcttggacgccaaggatgaactccgcgtcaaaaagttcagacgcgtaggtcgacccccgcgtcaaaaatctgagacgcggaggttgaacccctcgtcaaaaataccaaacgacggagtccagccccgcgttattgaaacgagtttcctcgttgatctcaagatcggaactcgccgaagcaagtttaatgaccacgaaggtcgtactcaccgccaattaaagggagttgggcggcatcggacttggaagcggctgatttcttgggtgccattgaaactcgtcggaggaggtgtacagcgttttgtcggaggtgagaatgaaaattttttcgttaaaatttcaagaagagccgaatgactcttgatttgacctctagcggtctatttatagacagctatgagctgtcaaatcataacggacaggattcgaggccatcagcccgcccaaactcgaccctcgcgttcgagttgtttgagcttccaaacgcgatgcccaccttcgcgttcaaatttcccaacgctgggctcacccacgcgttccaatcctcaaaggcagaaattatctctgtgtttggaccgctatgatagcagcttcttgactaccaaggctacgacacagccccagatgaataaaaaaagagctaacagcaatcgtcaaggcgaccaaagccgagaagaaacaaacgactccactggggagtctattagaggagtacagatagattacaaccaacaacggtgaaatcatctggctcgatcagacggagggagcaatcaatccactaaattttgggatccaaagtattttgaaaattcgtcccagtcaaccgcgaattttcgaaaactttggagggggttctgtaggttgtctaaaaatcacaatgaatagctgacccctatcaagctccgacaagggaagtcacaatcagacgactttctgatcactgcatccgcaactccacaatcgccacaaacacgacctcatttctgagatgattgatcttgatggctgcgacaacagcacgactaatattatattagcaattattggagatgctgatgagcagtgtaatgattttagaaatgaaaggttggacttagttggtgagttgcttggtagagagctgtgggcaaatatccatctaaagacactatggatgttgattccagtcaagttcctacaacgaaagctacaatcaaatagctttcgcgccgacaatcgaaagttggtgagttgcttggtagagagctggggcttttcacatagatcgagaagagttacaattcaacgacacttccgacgacggatgaaaactctattcagcagtcttcacaatctacggtgaaagttacaatctgacgactttcatatcctacaacagctaaagccaggattactgaacgacggtcctcgcaacgcttcatagaagaagttaaaagtcagaaagctccttctgaaacgcggatgtcatccccgcgttacaattctggaagtgcaggcgacccccgcgtttccaagccacccccgcgtctctaagatacaagccaaacgtgagtgaccctcgcgttcgtaggggtccaaccaacaccgacccccgcatttccaagcaggcaacaagccaaaatgcgagcgaccctcgcgttcaatgatgttcagctaacacccaacctcgcgtctcaattctaagaggcgaagttgggttctgaacgccagattgggcgtttgactcgttcaaacatgagtcgaacggtttcagaaccatttatcccacgttctgagggattttcgcccacgtaggagtggatataggggtcagttataacctcctatccccctataaaaacttaacaaactcaactgagctaaaggtttgattttcttggctcagatcgaccacaggaggctgacggttggagattttcagttcaaaaaaaaaaaaaaagagtgagcaaagatcggatttggaagatctcaaccactcaggttttggcgattcaacagcagcagcgaaatccttggagataggatttttgaatcaagctcagaagatcaaatctgagaggattcttcaacaatagaataacggcttgatcattaaccgaattttcagttctaacaactctattcacagagttctaactcgttcagagttcttaaactcattcagagttaaacatcaaactttccacagaagttcattattcccacgagataagagacggtcggatcgtcaacggagagcaaattcgacgcgagcaatcgaaggaggcattccatcgctaccgagaagaacccagttttaaacaaaggagagaatcaaactcgttctcttctcttttgtaatcaagttgtaatcggaatcaaagaaatataaatcaattttctttattcttttcattgtaatttttcctacatacaatgattattggttttgatttgataagaggtttgcgtttatataaccctcggatttattgggtgtttattcctaaatcttgtttaccgggtactaaaagtccttatatgggttgttacaagcttaagtgcttgataaattgtttcctctcttgcattttgtcaaaaatcttgttttgatttgtttctttgaattcattacacttcacttatatgatgatatttatgtgtttgtgcttatggatcatctatgtgtgccttataatgtattctatatgtggtttgatcaagttctacaaaaaaaaattctatttattgatcaaacattgttcttggacttaaaatttgatttatgatttcatttggttgatttgttttcatttgaaaacttttgcattctcatattcctcttcttttgatttcataaatctattttttatactatgttttcataattgtgtaatgagacacttctttcataaatgatatatctatatgtgtcctcattatattttttttatgagtggtgtttagcatattttttatctatgcttgctcacatatatttgccttgatctttattgtatattttccataaggcattttgatagggggagcaatccctatacttattttatactcacccatgcttatttgtagggggagctttcgctctctttcatctttatggtttttctcctttttgatgttgccaaagggggagaaatattgtgagtatattctttttgtttatatgcatgatatattatactttgtatattcatttcctttcatgtatatattctttttgtaaattatttgtcatcatcaaaaagggggagattgttggcctctttgttttgatgatgtttaacaaacaatttactactaatattgtttgtctagtgttgtgtttatctatctattgtagataaacaacatgttggaggatggatggaattgtgcattcacgatcatatcaaatggaggttggcggatatagtggttgaagcaatgcaattcaagttcaagatccaagttcaagcttcatccgtaagattaccaagtcaagctatttaagatcaagatcaagattgggtaatttagttttaggtttatattatgtgtgttagtactttaagctcaatcatatacacacatacacattttggttttgtatatatatagttatatatatacatatatattttagtttgatagtttttaagttttaatatgaaacaattgaatataattagaaaacatatttttgtttcatacttatatgcatatatatgattttatcaatatcaattttatttagttcaatgaaatcatgttttagtgcattatatgtgtattttgataaaatactatattctttatttatagacttcataacaatagtttacatctttcttcaagtctataaaatcattttgtattgtttcaaaacatggttaagctaaaatgtcaaaactcatatgttcacattttcatgttttggactattttgcaaaataataatattttttatttgggaggtcttttttgaaaaccagtttttgtagtatgtatattatcatgtctacaatcatttcccaaaattttatattttttctgaatttatttgatatttttaaacagggttttaaaatcatcaaactgcttctaaacctgttatttcatatatctgtttacggtcgaccacccttgttttccccttagtagccagcagagactttcgtggttgaccatgacggtcgaccgtcagtctgaaaaatcccacggtcgaccgctacggtcgaccgtaaaactttctggattttttttcagactcgaaagtggctcgcagtcgaccgtgaaaattccacggtcgaccgccgttcaccccaacggtcattttggtacagaatcagatttctgattcttgggctttttggtcttttcctttggggtttttggctgaggttttaggaggctataaataccccattgctctcatctttcatgatcaaccaagaagtttttaaaacaaaagtttaataagggtttaagcttggttagtttgttttaagtttggggttttacaaagagaagtttacatcaattgttgaagagtttatcttcaatatttcatcatcttctctttgtgtttatagagaagtttccttaactctatttcctagcatttttttatagagaagtttccttaactctatttcctagcatttttactattgtatttcatatcaattttattgctagttcttcttgagttaagtcttatttattctcattgttacacacacccatattgagcttattgtatttacattaataatataatttaggttgtgagattgtatcattgagagtgagcttacattgtgttctcatctatattagagaacaaatcatttgttgtattgtgcttattgtgagattgtaaagtttttggttagctagaaaacagagtgtgtagtggagatctcctcgaggtgaggagcagagacgtaggtcgtggggaccgaactccgtgaatgagagtgtgaggtgtaaataatgttcgggtaagcgtagaaaacccgattgtgatagtggatttctccccgggagtggggagcggagatattggacggaaggttcgaacttcgtgatcatattgtgtgtttgtattgtttatattaccctatcacaattgtatctttagtttagattatttacccttgtgttaatttatatatccttgcatatgtttcatcatataggatatatctctttgttcatattacatattcttgctcataatatattatatatctatcttgcaagaataatttattaattagttttattagcataaaatcggattagattagcataaaccctattcaccccccccccccctctagggnnnnnnnnnngccctcggcgatagggtcagttgatcccgcctttcgtgtcagcataaaagaaggtcgacttgatgagtcggagaggtcgaggcctctgttcggcttgggccacacaagtgggtttgaggttattttgttacaactcttattgtatcattttacaaatgcccgtatcttgggtgagtgaacaccataacagttatccaatagtgacacgcgatatgttcatgaggttcggtcttccgacctacgtccccgacaacctctcctgatgctaacttcactatcacacccggtttgcaagccgtaacttcttcacaacgatctcctcttaagattttataatccacacaagtgatctcctcgagatcaatctcaccacacaatcacaatgaaagaatcataggatcaagtgaagaacaagtaaagctcaagggttgtggagtgtggatttgagaaaaacaaagatttaaacacaattgaggattaagaattgaaagtttaagcttaagaacacttagaaaaccaaacttaagatttttctcttgctaaaatcattactgaagtgaagagagcaatggggtatatataggaaccccaaacaatagcccaaatcctaaaaatcaactagtacaaaaactagtcgttatagtactgatggatcatgtccggtcgatcgaatatttgaccattgcagactcagtaatctggagctggttcggtcgaccgataatgatgttccggtcgactgaccctcagtcatcggtcgaccgtgcaatgtaaatcggtcgaccgcaaatgactgtctgcagggtcatgaaaatagcttctttggtcagtcgaccgacgggcaaagctcgatcgaccgaaaacatgtacatacaggaatttgatgttagttgaaaatctgactttgtaaaatcaaaataaaatatcaaataaattccaaaaattataaaactttgggaaattcttataaacatgattttgaccatgttagaataagaatttctgaaagatcatttccgaatagttactcttttttcaaaatagtttaaaaacaatgcttttgtgaaaatatgtgttgaacctaatgagcttcaaatgttatcaactcaataacttgtctacatcaagcactagagagaaagaaaaagatgcaaacatctcacatatatgaatacaattctttggtcttgatatttgctcatattttgatgaagcttctcttatgtattgtgctcttgaaagcttttcttcaccacattgcctgcacctccatggatatcatcgttgagctcgattccatccaatcctccaacattggtactaacttgcttgataaattataatctacacaatataatcaacaagcaattaacaccaataatgatgtttgtaaatcatcatcaaaacaagagaactaataatctccccctttttgatgatggaaaactaccattattcaagagcatgaataaaataaaattttagtttatagataggttctccccctatctataagactctcccctatctatgtgcacaaattgagagatttctctccccttttgtcaacatcaaaatgggataaacaagataatatacatgtgttaaaacccacaagatactcctctaagtgttgacctacccgtgtcatattcttcaagtgtttggatttacgacctcttcctaggcattactaccaacccactcttagaattaaccttggtctctcccaaccactcctctaagtatccttgtgtgtgttttggtggaaagttagttctttcattagtggactcattacaacttcagtcattacaatgaacttaataaaaatgaaaataaaagattacaactctcttaaaacacacacaacagacgtttatcactcgctgtttatgtgggatctttgcctgtgccgggtttatccgtggaccatcgagtgatctgatcaagatatagatttcgttgactgcaaaggagtcaagaaattaaagtaactatctcggcaaagtgagataatcactcttctcgagaatcacagctaggtgcgatctcaagaaaaatggatgaacggatgtagatctcttgaactcttcctctttatgctgaatacattgccgagatctctttctcctctttgaaattcgtgctcctcactcttcagttcgacagtgctttgccgatgctcgagaatttcggatctgtgcgaatgaaggccctagtgctatatttataggctttagaagctcggtttttgattaagaaccgccaatttgatctcatccttatttgtaatcacttaaccacgttccaagatagcttcaaatcagttggatcataatttaccaaaatctcgacggttaacggcgaagaaatggtaaaaaatagtattttctggcctgagacactctctgtatctcggccctggccgagacatagtttgtgtctcggctggctgagacacttgttgtgtctcggttttcgaccgaggcgtcgttttgcgcgctttgactgttttcgctgtaattttctcgtccaatctcggaatgacttgattcaaagtgcgtcagaaagtcgaagaagagatctacaacttcctataggtgaatcatacgtggagtggatgagacacgagtggaatttctcctttcgtgagtgaaacgtaacttccgattggatcgtttcttcgttattctgtcgttttgttgattcgtacgcttcgtagactcgtttcatatgcttgtcaccgtcagataatcctctttgacttgaataatgatgtttatcgtcttctctccatctcgagttgcgtgcgggaactcataagcaaatttgacgcctacagtgtgcttaaacatgttttgacaatgtagatcacaaagaaaaagtagctatgaaatcgatagcttaaaatcaatagcaagcaaaaggcatcaaaacaagtatttaaagaaagcacatgcctaaatcaaaaatcttcttcactaaggggtttggtaaagatatccgctaattgtgattttgtgtcaatgttaacaagggaaacatctttcctatctacatggtcacgcaagaagtgatgccgtaccttatgtgtttggttctagaatgtaaaacagagttttttgaaatattaattgcactagtgttatcacaaaatatttttgtatcataaaaatgtaaatcaaaatcaactaaattttattttatccataaaagttgtgcacaacacaagccggcggcaatgtactccactttcatagtggataaggtaacacaattttgtttcttggatgaccaagaaacaagtgagttacccaaaaattgacattgtccactcgtactcttgcggtctacctttcatccggcaaactcggcattacaataaccataaagatcaaaagaagtgttcttaaggtaaaacaaaccaagttctatagtgcgatgtatatatttaataattattttaaccgaaataagatgagattttctaggagaagcttgaaaatgatgacatgcacaaacactaaacataatatccggtctactagcggtgagataaagtaaactacctatcatacctcaataaagcttttggtctaccttctcaccactctcatccaagtccaacttgatggtggtactcatgggtgttggtgcatgtttagagttctccattccaatcttcttgaccaactctcttgcatatttgctttgagacacgaaaatcccatcattggtttgtttgacttggagaccgagaaaaaaaatataagctctcccatcatgctcacatcaaattgttcttgcataactttagaaaattccttgcacaaagattcattagtggcaccaaaaataatgtcatcaacataaatttgaaccaaaataaattattttcctttttctaataaatagagtattatcaaatttcccttttaaaatactattatcaataagaaaacttgagaggcgagcatactaagctctaggggcttgttttaacccatacaaagctttttatacccggtaaatatgattaggaaatagtggatcaataaaacctgggggttgctcgacatacacctcttcttcaataaaaccattcaaaaaggcacttttaacatctatttgaaacaatttgaaaattttaaagctagcaaaggctaaaaatattctaatctgctccaatcttgcaactgatgtaaaagtttcatcataatcaatgccctcctcttgattgtatccttgggcaactatacgagatttatttctagtcattatgccaaattcatcaagtttatttctaaaaaacctttttgttccaataacatgaaaatctttaggtctaggaacaagtttccaaatattatttctttaaaaattgtttaattcatcatgcatagataagatccaaaattcatcattcaaagcatcatcaacacgtttaggctcaatttgggataagaaagctacattaccacactcgctcatagcctttgagcgagttaaaactcctttagataggcttcctataatttactccttgggatgatccggtgcaaatctccatgtcttgggaagttcctcttgattttgttcaaggttcctttccctatctttgggtgcatccgttgagggtttgtcatttacttacataagttccaatccttcctcaatattatcatcatccctaggcacacaatctagcaagccatcattagtttcatcaaaggtaacgtttatagattcttcaacaacaagtgttcgtttgttgaaaactctataaaccttactccttgatgcatatcccaaaaatacaccaaaattaatatttgaatcaaatttatcatggtgatcttttatgttcaaaataaaacatctgcaaccaaaaatttggaaatagctaatatttatagttttgccaaaataaagttcataaggagttttcttgaaaatatgtctaattaaaacatgttttaaaacatagcaagccgtgttgacggctttcgcctaaaaatattttggcaaatcaaaatcattaatcataatacgtgccatctcttatatggtacgatttttccgtttaactatacaattttgttgtggtgtttttagagcggaaaacgtaggtgtaataccatgatggtcacaaaaatcactaaaaactttattttaaaattcaccaccatgatcgcttctaattgtttgtggaaaatttgcagtaaaagaaacgaaggaaaattgatttgtattcctttaatctcgattacaattggatttcctgattataaaagagaagagaataaatttgattctcccctttgtttaattctgggttcttcacggtggcgatgagatgcctccctcgaatgctcgcgtcgagtttgcttctcgttgacgatccgacgtcttgtttcactggaacgtggtcttctcctcacgatttgacgttgtggagaactctgaacgagtttaaaactctatgaaagagttgatttaaccgaaagtcggttataagccaaggatgaagaagatcttgttgccgatctccaaagctccagaaatgctctaaggatcctgttgacgagccaagaagttccaacagatccccccttgaactgaattgattttcagttatttataggggattaaggggtgtaaccacctccttaattcgctcctaagtggggctaatgagatgtaaccgccccttaaatcactcctgagtggagttgtgatcccctcagatcgtgggaaacggttttggaaccgttcagctcgtgtttgaatgagtcaaacgcaggcccgcgttctggcatgaattctgtgtccaaacgcaatgcctaaaagcttgaacgcagcatctggaagctcggacgcagcgtttggaagctcatttgcatcgatttaagagctgcgtttggcagcgaatctgagctgcgtttacagcaatttggaagctgtgtttgtatgatttaagagctgcgtttggcaatggatctgagctgcgtttggagctggatgtgacctgtgtttatagcgtttgaaggctgcgtttacagtgatttggaagctgcgttggcggccgaatctgagctgtgtttgcaacttttggagctgcgtttgcaacttttggagctgcatttgagctgcgttcgtggctatgaacgcggcgcatcttgatgctggtacgcggagaggactttcacgtcttgatttgaagagaccgtcgatttgtcgtctctttctatcgaagttttgcaaagatcgtcattttgtaatccttactttagctctttgatatacaagagtcgtcagattgtaactgtcgatgttgattgtgaaggctgttaaactagagctctcatcggttgtcgtgaaggtcgtcagattgtaaccttcagcgatctacgtgaaagtcttcaaattgtagcattcaggaagtcgtcagattgtaacttccatcatcggtgtttttatggggatagctatctattgtgatttttagacagcctacagaaccccctccaaagttttcgaaagttcgcggttgactgggacgaattttcggaatactttggatctcaactctgatcttggagctgttgattccttgtggtaaaggatttattctctgcacttgcttcgaaggcatcatggttgaagggatttgccacgtaggacctgtgtgaaggtatgcgccataatcctgcttctggaatgtgggggtggaccctgcattttgaacttgagatgcgagtctcacccttgcatgttgaatttggaacacgggtgtgacctcggcgttcggtttttgcatcgcgggtctgacctcaacgttttgacttaagacatggaagtggcttccgtgcatttttgactaagtctttgagacttgtctttggctcatctgttttaagtctcggctcacatccattaagctgatggacctgcaaacgtgcataggatttttggcaaaccctcagccatcaacggatttgataagcctttaccgactaccgtttgagtcgggctagcatgtggattgtctaagtccgttccacatgtaacgttgtgctaagagaatgaaccctcttagacttgatgctatgattttgaatacatagactttgtcattttcacgggaaacgactaaccggcaacgcgtgttaggcgtaggcttatctctaattagggatcgagataaagtcccccatgcgtgtaaggcatggatttcggtgttattaataacaacctgccacgatgttgaatacgtggactttgtcgttatttcttcctgtgttactgaaagaaagttagaaacgccagaggtgtaatattaacttggcatgaattttcacttagagtgaaattcagaaattttctttattatcactaggataattctagaaaatctttaatccactggggattttacaatgacaacttgctattcttgttgaaaaaggattaacaagttcattggggggtttgactgttagaggtgtgatgttaacctaacagtatttttatggacctatcgctccattgaagagagtcgataagttgattgtgtcgtcagaggtgtgatgttaacttgacgggtaatagacatatcgctctattgaggagagtcgataagttggttttgtcagaggtgtaggattaacgtgacaagagaatgttgcgatcggagcaactttgtggacttatcatcctattgaagaggattaataagtggatttgtcagaggtatggtgttaacatgacaagagaatatgttacgatcggagcaactttgtggacttatcatcctattgaagaggattgataagttgattgtcagaggtgtgatattaacgtgacaggatttgtgttgcgattggagcaactttgtggacttatcatcctattgacgaggattgataagtggactgtcagaggtatgatattaacgtgacaagagaatgtgttgcgattggagcaactttgtggacttatcatcctattgacgaggattgataagtggattgtcagaggtatggtgttaacatgacaagaggatgtgttgcgattgaagcaactttgtggacttatcatcctattgacgaggattgataagtggattgtcagaggtatggtgttaacatgacaagaggatgtgttgcgattgaagcaactttgtggacttatcatcctattgaagaagattgataagtggattttgtcagaggtgtgatattaacgtgataggaagatgttgcgatcagggcaactttgaggacctatcgctctattaaagagagtcgataagttgattttgtcagaggtttagtgttaacatgacaggaatttgtgttgtgattggagcaactttgtggacttatcatcctattgacgaggattgataagtgaatttgtcagaggtttagtgttaacgtgacgagagttgtgttgcgatcggagcaactttgtggacttatcatcctattgacgaggattgataagtgagttgtcagaggtttagtgttaacgtgacaggatttgtgttgcgatcggagcaactttgtggacttatcatcctattgaagaggattgataagtaggttgtcagaggtgtgatattaacatgacaggatttgtgtacttgtaatttgaacaagattttggggactagcgtctcgctggggagaattgctaagtgagtttatcatcagaagcgatgaattttgatactaagattttgaagacttagcgtcttgctggggaagattgcgatttgagcaattttgaggactcataatcctattgtcaaggattgataagttgattgttgtcagaggtatattgttaacgtgacaaattgggagtgatgcaagttgaatgcatactctgtggggatgatgatcgtcagaagtgtaatgttaacttgacgatgtaaaagattcgttactcttaatccagtggattccaagtaaccaacctccagtcttgattaagacttagcaggggaataagaagaagtagataaggcacatcacgtagtgggacactatccatgaagtcggaacagaggcacatcacctggtaggccattatctgatgagtttgactatcagaggtaactgttaacgtgatagttttgtggacccgccatcctacttgaagaggattggtgggggaatttggaggaaaaggactatcagaggtgatggttaacgtgatagttttggtggacccgccatcctacttgaagaggattggtgggggaatttagaggaaaatgactattagaggtgacggttaacgtgatagttttggtggacccgtcatcctacttgaagaggattggtggggaaatttggaagaaatgaactatcagagttaattgttaacgtgatagttatggtggacccgccatcctacttgaagaggattggtgggggaatttggaggaaaaggactatcagatgtgacggttaacgtgatagttttggtggacccgccatcctacttgaagaggattggtgggggaatatggaagaaatgaactatcagaggtaattgttaacgtgatagttatgatggacccgccatcctacttgaagaggattggtgggggaatttggaagaaatgaactatcagaggtgacggttaacgtgatagttttggtggattttgtggttgacggaggtgttctattgaacatgacaactcaaaaaaatttattggtcataatcgaatgaactacaaataaaccaacccccagtcttgaacaagtgcagggggaaaagggtagacatggcacatcgcctaatgggccactatctaatgaggttgactatcagaggtaattattaacgtgatagttgttggacctgccatcctactgaagaggattagcttcaatagtcgtggtatcttcttctgactgagaagattgggcttggtccgattgctcaggttgatcctgcctactttgttcttcagctttgatcctgacaataatcttttgagcctgttcgccttgagagattagttgtctccaagaacgacattctgcaactccgattcgggctaggaggtcggtttgcaaattgtgctgacaggtctccactagggtagattgtgtcatacctgacgaacaccggagagccatggttcggaacctcttgacgaaggctttgacggactccctcttcttctgcttagtggcgagaagggtatggatggagacttccgtatcctcttcaaagaatctcgacaggaagagtctttctagatccgcccacttttggatacatcgagcaggcagtttcctgaaccattcaaaggcaactcccttgagggtgccaatgaacaatcgagccagtatgacgtcgtttgatattatattcccagtctgtgacttgaagtgatagatatgttggttcggtgaacccgtaccgtcaaaagtttgtatcgtcgggacctcaaacttgggaggataaggggctgtatcctattcggcaggatagggcctggcaactccatcgtcttggagctcacttctgtcaacaatggcattgaggcgggcttccaattcttccattttggcagattggagattctgctcgttctccgtctctcttccttcatcagaggaagattctaagttgtgggcttcttagtcagaagccgtgtcatcaaccactgaaaacactttttcgaaagagctttagagagagattttggtttttccgcacccgcaagcccagcccaagcctattttccccttccctttacttgtgtgaagtcgggatgaagacgtttttcctctccgggaggattcttgcctaggtggcaactctgtcttctgagatttagccttgtctgcgacgagttgagtcaacaggtctaggagttcattgagagtcttctgctgtgatttgagcatggcgtcttgctcagcaaccctctttgaaagatcttcagaatgttctgccatgtgggtgaagctctcatgcccaatgaaagagcttgatgattaagactcagcaatggctgaatgttcatcatcgaaattagttcctgtggctaacctccgatagttgacagggggaatggctcccgttcgagtctgagtatgttgataaactccttcaaactcgtctgtgatttctctgacggtcagtgaacgccttgtctcagagtcattggaactaggacctgaggttttccctctgccgatcacattgatagtgacctcgggtcgttgttggttgggcaaggcaacatgcattaattggtcgaacaccaattgtttggccgcaaatgaacaacattgacatcccgagaggactgtaggaatcagtcgttcacattggaatgaacgaatgacttgttgcatcggtctttctcttgatatgaactctctcaaatctattgtaaagattcgaagagaattactcactgattgtgaggtttgaattggaacccccagtctatgattgggtaggactggctcttggtgaacatgaatctagtttagatgccttggatccatgaacttcttatatccgcccctcgatctaattgcgtttcatcagcgagccgggggtcacgatatataccaggctctgtattggatttcatcaactgaacgcatgcctgagcttcaggttttgctgatgaaacgcatatttgagagttgcgtttattttgtggaacgcacccctgagggttgcgttcattttgtggaacgcgcccctgagggttgcgctcagtcttcttcacacagagcctatgtttgggctcatagacgcgagacttgcattctgaaacagaaacgcagggcatagggtcgtgtttaggctcacaaacacgaagctcgtgttgacttaaggatcgacattctcggagatgtgctcgtcgtagggatctcctcctgcgtcgagcagcattcttcttagcccacttcaaggcctttgtagcgacgtcaccatctgtgttgatcaagtttgtcgcctcaatgagcatctttcgaccggatacctgtcgtcttggcacaggtttggctgaagctaagcccactccatcgggggaggggctgtccgaacagtcttccttaggcggttcggctgcaattagagcagttggagctttagtctctttggagactttgtggatcttgcgcatagccttggggctaagggatccggaggagagggcttcctcatacttggcttgatcgaactctatgactagagtttcaaccgtggttccagtgagatgaacatcggattgcaccaccacttcttcgtcagagaagctagtttccccagcggagtcgccatcttttgtttgtggaaaatttgcagtaaaagaaacaaaggaaaattgatttgtattcctttaatctcgattacaattggatttcctgattacaaaagagaagagaatgaatttgattctcccctttgtttaattctgggttcttcacggtggcgatgagatgcctccctcgaatgctcgcgtcgagtttgcttctcgttgacgatccgacgtcttgtttcactggaacgtggtcttctcctcacgatttgacgttgtggagaactctgaacgagtttaaaactctatgaaagagttgatttaaccgaaagtcggttataagccaaggatgaagaagatcttgttgccgatctcaaaagctccaaccgatccaactcctcgatctgattataaaaaatccaatcctttaactctgttgagtttgttgttatttataggggattaaggggtgtaaccacctccttaattcgctcctaagtggggctaatgggatgtaaccgccccttaaatcactcctgagtggagttgtgatcccctcagatcgtgggaaacggttttggaaccgttcagctcgtgtttgaacgagtcaaacacaggcccgcgttctggcatgaattctgtgtccaaacgcaatgcctaaaagcttgaacgcagcatctggaagctcggacgcagcgtttggaagctcatttgcagcgatttaagagctgtgtttggcagcggatctgagctgcgtttacagcaatttgaaaactgcgtttgtacgatttaagagctgcgtttggcaacggatctgagctgcgtttggagctggatgtgacctgcgtttacggcgtttgaaggctgcgtttatagcaatttggaagctgcgttggcggccgaatctgagctgcgtttgtaacttttggaactgcgtttgcaacttttggagctgcatttgagctgcgttcgtggctatgaatgcggcgcatcttgatgctggtacgcggggaggactttcacgtcttgatttgaagagaccgtcaatttgtagtctctttctatcgaagttttgcaaagatcgtcattttataatctttactttagctctttgatatacaagagtcgtcagattgtaactcttgatgttgtgaatgctgttaaactagagctctcatcggttgtcgtgaaggtcgtcagattgtaaccttcagcgatctacgtgaaagtcttcaaattgtagccttctggaagtcgtcagattgtaacttccatcatcggtgtttttatgaggatcagctatctattgtgattttttgacagcctacactaatttttacaactttcaaatcctttttattttcaattctttttactaaatgagagaatttttcaaaacattcatctttattagcaagaaatataacccatgtaaagcgtgaaaaatcatcaacaataacaaacacataatgctttcctcctaatgaggcaacacgcataagactaaataaatcaagatgaagcaattgtaaaggtttagtggtggatacctcatttatagatttaaaagagtttttgatttgtttacctttggtacattcctcacattgagaatctttaatgcatgttagacttggtagtcctcttaccaagttcttctttgatagcttagagattaacctcatgtgagcatgaccaagtcttttgcaccaaatccaaggatctccatccaccgtgacaagacacttcacatcttgatctaaaagctcattcatctcaaatatatatacattagactttctaagggcaacaaaaattgctttatcttttagacttacaatacacttatccggtttaaaaataacatcatagcctttgtcactaagttgactaatacttaagagattatgattaagtccttttaccaaataaacatccttaatcacgggataatatatcttaccaatattaccattacccacaattttacctttctcaccgtcaccaaaggagacattgcctccttctatccttgatagagttacaaataagtcattatcacccgttatgtgatgagagtaaccactattaaggcaccacaactctctacgtcttgtacgagatgttccctacatgtaaacaagaggtagaagctttagatacacaaatctttggtccttggatattagtacacttggcacccttaggtacccacatcaacccataataataagcattatctctaaatctacaatgtgtagacgtgtggccatgtctcatgcaatatgtgcaaacaaaatctttcttataagtaggggtatgagatctatgatgctatgttcttctaaggtggtgatgagtattactagaagaagcataattagttttatctttaatttttaatctttcaatttgagaccttaaatgtttattttcaaattcaagatctccaattattttgtcttgtaaagcactaacatcatttagtgaggattgtaaaagcttaaactttgagtcacatgaatcatgcaaatttttaaaagaagaatgttcttttgctaattttttaaattcaaaattcaattcttctagtgttccaagttcacattacatataaaaagattcattattggaataggattgtacctcatcttcatgagccatgaagcatatatttgtatcataaagagcaatcttggcggctttgatgcggcataaatatgtaccaaaaatgttgcaagtgcacaaccgtgtcaagttatagtataaagatatcgatccacgaggaaggtgttttgtaggaaaaaatataaaatcagttcttatgttgtgtgcaagacaaataggagtgataagtgaatgtgattatggagagatgaaaatgattgtgtaaatgaatatatttgagagtggaagtgataatataaatgtgatcaacaaggcaagaaggaaaaatcaagaacaaataaaaatcaagaatgtaaagatagtggattcaattaaagatatgggtaatctagaattgaatccacttcttagaaaaatatgattccctagagggttctagcctaaaggcgaatcaaaaaaaataaaaatgaataaaaagaaaaactaaacccaagagggttctagcctcaaggtgaatagtgcaagaaattaaaatctaactacaaaataaattgtaaaatctaaactacaaaataaattgcaagaattaaataaaaaaaaaatctactctataagcatgaaatatatctaatctataagtatgaaataaatctaaggcaagagggttctagcctattggctatttaaacaagaaaataaaatctaattacaaatctaaggcaagagggttctagcctattggctatttaaacaagaaaataaaatctaattacaagcatgaaaataaatctaaactaataagcaataaaagagaaataagaaaaataaaccttcaaattaatctccatcttcatctttgatacgagttgccatgcgagcatctttgatcgcggaattatcaaaggtgggttgagaagaggataacagaaacacaagcacaattcaatatatggcgaaggaaattaccttctctagattatgagtatgaaaaaattataatctctctctcacaatctcactagaatcgagaacaaactcttaattctcactaaaccctaatacaatgattagaatctctcttaattacctctcttatagtttagaaaccctaaaacaatcttttatataggtatataaacgtggatggtaatttggtaaataaccagacataaaaccaacaggaattcgtgtgaacagaaacccaaacgaaccaggaaaccatcgatgagtcgactcatgactgagatgagtcgactcgtccgaaaccggacaaaacacaaaaaccagcgaaatgagtcgattcatgacagtcatgagtcgactcaacctgatgagtcgactcatgactttgttatgaggactcacaggctgaaaactggatacttcgattcttctgctcgtcgtctcgttccacgcttcctcctgcgtttccttatactgtttgacacctctattcttatgttatcatgagaatcatctatcctcaagctcccatgaggatcgctaagttccgaagagaagatacacccgtatcatgggtcccctctttaagaacttgaagtcccattcaagttagaacctttgctgaggaaactctcgagctcctccatcttttctgtaccacctggccttgctaggaatccggtctcaacattcgatcagaaacaactcattcgtcccgcgtctcgtcatagtcaccgttcgctctaagttgcaatcctttgtcgatggcttttctagaagtctaatgcacagcgagacaaacttcttgcttgcattcattagtctcttcgctcgcgctaccgtccccaaacttgtctccttcagaagagatgccgaacgaaatatgaactttacaccatccttagtgaaggtgtacttctgagcccgcctcttgtagatcgcatatctatcccataagtacggattacctagtataatctgacaaacatccaatggaacgacgtcatacgtgacctcgtcaatatacgacccgtggagtgcaaatctgacagtgcattgatcaactacactcagtttctcctccttctgaatccaccccaatagatagggcttcagatgcttgactgtcttcagacccagcttctgcaccaatgcctcggatatcaaattcttctcgctgcctgaatcaacaatggcatcaaccaaactggtcttcacttgcaacttaagaacaaagagttgctctctcaggtcgtcgtcctctttcgtggtctacttctccatcataaggttgagactgttgttgggctctgtcatccctgggacttttttcggaccttgagctatcatgtatgcttttttctcctccttcttcttcaaccctcttggcttgagatggggatacttctcccagcaccgatcagctgtgtgccctgtcttctcgcagtgactacaaatcagccctgtcttccctagatcacccttcttcttctcctccttagattgagaaccactagactcgcctcccgtctgtttggagtctcccttagcctcgttgcccttcttttgcttgccctcgatggcaatagccttcacgctcgcctctgtaatagtctcgactgtgaataacttcatctcctttcggatgtaatcgctcaatcctgccatttacttcataaacacgaaatattcctctgtcgcaatgttgaggaccatcgcctgctgctggaactccgtggtgtattcttaaacggtttgattgaccctttggcgtaagccgtaccacttgtaccaacattctttaaggaatcccactgggtagaactgctttctcagtaactcattgaacttgttccacaacaccgccttcttctcctgcttgcagtaggattttcaccacgtaaacgtgtgcccggaaagcttcaaagtcgcgaacacaatcttctcttttgacgaatagccataaagagtaaaatacgtctccatccgctcgatccagtcatcaagcctctcgacgttaacactcccatcataaacaggaatctccaccttgaagtcaatcttcaggttctgataagatcttacccccttgatgcaatgcagtcttaacggtctcctcctcctcatcggaatctgaatctactctctccacatcggactcaacaattttcttcgaagaagattcaccttgttttccacctccatggataagactgacgagttgtgtgagagtcgaacctatcgtctcgatctgcttctccaatgcatcaatcctcgttgaattgtctccttcgaccatcttcttcttccttaaaacatggactccttccaatgaaataaggatctcgccaagcttcttgtattgggatcgagtaaggaccatacataggatgccccttcaccggatctgatgctctgataccaccttgatacgagttgccgtgtgagcacctttgattgtggaattattaaaggcgggttgagaagaggatgacagaaacacaagcacaattcagtatatggcgaagaaaattaccttctctagattatgagtatgaaaagattacaatccctctctcacaatctcactagaatcgagaacaaactctcaattctcactaaaccctaatacaatgattagaatctctcttaattacctctcttattgtttagaaaccctaaaacaatcatttatataggtgtacaaacgtggatggcaatttggtaaataaccagacacaaaaccaacaggaatttgtgtgaacagaaacccaaacgaaccaggaaaccatcgatgtgtcgacccatgactgagatgagtcgactcgtccgaaactggacaaaactcaaaaaccagcgatgagtcgactcatgacagtcatgagtcgactcaacctggtgagttgactcatgactgttatgagtcgactcacaggctgaaaactagatacttcgattcttctgctcatcgtctcgtttcacgcttcctcctgcgttcccttgtactgtttgacacctctattctcatgttatcatgagaatcatctatcctcaagctctcatgaggatcgctaagttccgaagagaagatacacccgtatcaatctttaacttcatcatccaacaaagagaagaagagaaaaatttaaagtggtaaaaaatttattttattaattgtaataaaaagttataaatttggaaggtcttctcaattaagagtagccctcctctccaaaaggagttacaaaaattttcacacctctaacccctcactctcaacccctatttatagtaaacatcagtgaatgagagccattggatcaaacttgatccccaagaatgcaattatcagccattgacgcgcgctacagtaatctggtatcgatgcccgcattaatgctggcatcgatgctccaataaaaattttaacttcacggttggcttcgtctcgtcgagataggtgattttcatatattatatgttaaattccgccttccggattaggagatatagtcatttctttgcggccaactatcttgaatacatttttttcatatttaatttttttattttctccggattctacaagctactcggcttgattctgggcttgggctttttgactcttgcttgtgttcttcatttaattcatgggtttttattgagataagagatcttgggctttattcttcactaacctgcaattaaagataaaaacaattattaatggcatatttattcatataaaatagataatgagggtataaatatgtaataaaatatgattattaaataccccacacctaaacttttgctagtcctctagcaaagaaagaaaaatgaaagaagacctaactcactttttgcaggaatcgcggttgtattcagcgcatacaacaagcctttaaacccctaggttaccctagtagacgagttatagtctcatgagggtttgcagtgaatatacccacaaaattcggtctacttgccaaattaaagaagtcagtaaataactaaattcacttgataactttagacaatctaattgaagctagttatcactcaagaaaaagtttttataaataacttaaaggtaaatttcctagaaaatcttctcattatagcaatacaaaaccaagccaaacttagaaatttaacttaaaagttttgaaaagaacatgctaactctttgtttaaaataatattcaatttgcttgatctaaaatattttccaagatcatatatacaaatataactaaaatatttattagtatttttattttttttatatatatttttatattattattattttttaactctttcttccttggtgattttttctactttaacgggttttctaagcgaccatttaacgagttttaggccaatggatcccaacccatttaggcttagatcattacgtatggaaatactccttgggattaattactcggtcaacttaggctttataagatagaatcaccttgaatttaagagtttttttcttttggtgtctatttttcgcactcttcttttgttatatttttatgtatatgtatatatattctgaaaaatatgtaagtcaagacactttgaaaatttatttttgactctaagctaagcatgcataaattccattattttaaataaaaatctaagttaagacttaagtgaagtattctactttgaaaattatttcttaagaaatttatttagagttatcataaaaggtaaacttgagtaaataacaaactagagattagaaaatttaaaatttatcaaataaatcaattattacataactctatcaatttggcaagtgacgatatttttataaatttttttaaggaaaaggaaaaaatgacaaaaatgcaactaaaaatgtaaaataaagagaaaaaaataactaattctcacccccacatctaaattttacattatcctcaatgcaaactccatgatgcacaaagtaaagcagataagaagtgaagtacttacatttgattagctgataaaaatctacaattatctttgatctgaggaggatagaaacaaaaaattattattctcttctttttttcttttttctgttttttttacaactgaacaagaaactctcaaatgagagaagaataaattctttttattattctgaaataaacaaaaaaaataatgtagaatgaagtgttcaacacgaagagctcgtattctaccttgaatcctaccttattgttgaaaattctttcccgaattttaaataaattcagaatgatataatcaataatgtgaaattccaaacatttcggggtgttcaataattcttgcaacaaagtaaggtaggtattattggtgtcatgcattttgtattttttaatgaacttagactcttgtactgtgaagttttattttctaacaaccaattcttctgtagagttctgaaaatttagttgttgatttttctccaagaatctaagttcatcaagaaagagttcttcaaaatttaattcaaaacagcacatgtttaacacagttttattattctcaaggacctgatctgcttcttctaaaaactctaactcttcatcaaaaatttcctcaaaactcaaatcagactcttcttcttcttctgaactttcctgaatataatttatttctagaggctgattatttggatttggttggtcccctggattaaaaatgttgagatcagcagtcaaattcccaaaggacagctttatttgaccagttctacagttgatgagagcattagaagtggctaagaaaagtcatcctaagatgacaggtgtctgtcctttgggattagaaacaggctgtgtttccaagactacaaaatctactggaaaaataaaatctccaaccttaatcagaacatcctctaactcacccatgggtaccttaacagatctatcagccaactgtaaggtgtatctggttgggttcagtacacatagacccaattgctggtagactgaatatggaagcaaattaacactggcccttaagtctaacagcgccttatcaatgtgagtattatcaatgatacatgaaatgatgggggaacctggatctttacgtttcaaaggtatgggatttgatagtatttcactgatattggcggctaaaaagactttctttggaacatttattctcctcttcttagtgcataattttttttaaaaatttagcataagatggaatttgttcaattacatctaagagaagatgttgaccttaacctgcttgaatgtttctaggaccttctcctcctgaggagagtatttcctaggcctgagtctatctagaaagggagcaactggtctaaatctatcaaaaataggctcaggttcgggttcaagttcttggtcatctaaggggggtgattgttgaatagattcatcaaaaggagaaggagaaggaatttatattagatcaaaagtttgacttggaggagttctcacttgattatctacctgtctacctgactgaagtgaatggattgcattcacttgagcttcataggatgaactgcatcctgtgtctttagggtttaccacgggttgactcgaaaattttcctttctctctttcactcacggcactagttagttgaccaagttgggattctaatttagctatagcttgagtgttggagttgagcatttgtccagttgattgcatgaaggaattcagagtgctagacgtttgagtcaacatattcgtggtttgagtggatgccttaattatggtttccaaacctctttccaagacattgagatggttatcctgatctgaattgtgatgagcctgaattacagcttgatgaagaggagactgattttgatacgacagattgggttgttaaaattgtggatgagaattaaaaggatttgtgttttccctaggaaaatgttgggtggaagcgggagtgaagttttgagttccgagagaatttccttgattctatgcaaagttgggatgatttcttcaacctggattgtaggttggagaaaatggattatttctagggcgttggaatacaacgttcatctgttctcatgcatagttatttcctaggagaggacattcctctgaaacgtgggtaggagactgacaattatgatatcctggggtagaaacatgattgatttgagctagagcttgttccttaatttctaaggcttctaacctccgcagaattatcgtcatcttcgcttcagaagtaatgtttgactccaaggaaagaccattagacttagaatggggaactgataaaaccatgttatcacagtgttcccattgcattgttttctcggatagactctctagaaattcccaagcttcatcggtatttttcctcataaaatccccatggcacattgattctaaggaagtttttgtagaataatctaatccctcataaattatttggcacaatcaccatttttctaaaccgtgatgaggacattagatgagaagatctttaaatcggtcaaaatacttccaaaaaggttctcctaggataattttaaaattcatgatgctgtttcttagctttatcgttttatggataggaatttttttttttaagaaaaacggtgataaattcctcccaagtagtgatggaatttacgggtaagctatacaaccatttttttactttgtctttaagagcaaatggaataaatctgagtttgatcgcatcttctgttaattctctcattttaatcataatacacacttcctcaaattccaagataaaaatatatgcatcttctgtttcatttccaaggaatttgggaagcatatttatgtaatacgctctaagctcaaaatttattccatttgtttcggggagcctaatacaagaggggattgcattcctaatgggatagcacatatcttgaagaacgggtggattaggatacgctatttctatgattggttcaaagcgaattaatcgatgtgtattatccctaatccacggttgcatacaccaaaactatttctttttatactttttttattattataaaggttagttttttttaatgaggagagaatggaaaaagagaaaaaaatcctaactaaacaaatcaaaatcaatcactttccaatcactctaactctagggttaagcttaactcaactagactacctcctaaccaaaaactcctaaagtgaaaagattaaagttttacccgggtagttagccaggtaaggatagtactagagggtgatcaaagatcaattaagtacctctttccttgcggagcgctttacgcaacccctaaaccttgccttagacaccaactattctgagaaaacttaaaccggttcacttaaggatttcttgttccttattgagctcgaatccttaggggccaacgtctaatgagttttattaggcttgggtggtgtagtgaggaattagtgatttttaggctaagggaagggtgatgaaatctctcacattatcttgaatattaggttttacccttaaaaatatttttaagtgtgtgccaaatcaagatgctcaaatcacttggtgaattcctactaacaatatgaaatgaaacccaatgaattaaaagcaactaaaaaggatggaaaagaaaaaacctttttttttaattagggttaacaattaaacaaatgagaagggggatattatttgaatttattatcttgttagtaaatgtcaaagtggagggtgaattttattatggtcaacaaaaataaaatctctttttttaagtcctaattgtctctaattgtgaagaagtagctaaagggtggaattaaaaattctaaaaagaagaattacctacaagcaaatcttcaaatcctagttctccaatccgcgatcttcaagcttcaagcgtttccttcacaataaacacacaagttaaagaaccaaaataattaaaacatacttaagcaccttccccggcaatgacgtcaaaaacttgatgcggcataaatatgtaccaaaaatgttgcaagtgcacaaccgtgtcaagttatagtataaagatatcgatccacgaggaaggtgttttgtaggagaaaatataaaatcggttcttatgttgtgtgcgtgacaaataggagtgataagtgaatgtgattgtggaaagatgaaaatgattatgtaaatgaatatatttgagagtggaagtgataatgtaaatgtgatcaacaaggcaagaaggaaaaatcaagaacaaataaaaatcaagaatgtaaagatagcggattcaattaaagatatgggtaacctagaattgaatccacttcttagaaaaatatgattccctagagggttctagcctaaaggcaaataaaaaaaataaaaatgaataaaaagaaaaactaaatccaagagggttctagcctcaaggtgaatagtataaaaaattaaaatctaactacaaaataaattacaaaatctaaactacaaaataaattacaagaattaaatgcaaaaaaaataaatctactctataagcatgaaataaatctaatctataagcatgaaataaatctaaggcaagagggttctagcctcttggctatttaaacaagaaaataaaatctatttgcaagcatgaaaataaatctaaactaataagcaattaaagagaaataagaaaaacataccttcaaattaatctccatcttcatcttcatcttcatcatccaacaaagagaagaagagaaaaatttacagtggtaaaaaaaattattttattaattgtaataaaaagttataaatttggaaggccttctcaattaaaagtagccctcctctccaaaaagagttacaaaaattttcacacctctaacccctcactctcaacccctatttatagtaaacatcagtgaatgagagcccttggatcaaacttgagccccaagaatgcaatttcggccgttgatgaaatctggatgacttcgcatcgatacaggcatcgatgcccgcatcgatactggcatcgatgctccaataaaaattttgactttacggttagcttggtctcgtcgagataggcgattttcatatattatatgttaaattttgcctttcggattggaagatatcgtcgtttctttacggccaactatcttgaatatatttttttcatatttaatttttttattttctccggcttctacaggctactcggcttgattctgggcttgggctttttgactcttgcttgtgttcttcatttaatttatgggtttttgttaagataagagatcttgggttttattctttactaacctgcaattaaagataaaaacaattattaatggcatatttattcatataaaatagataataagggtataaaattgtaataaaatgtgattatcaggcttcttcgtcactatccgagtcgcttggttcggatttctcccatcccgcatacattgccttcttctttttgtacttcatgtacttctcttttatcttgggacaatcctttgctatgtgtcccggtttattgcactcaaaacatttacctacacgagaggggaacttgttagaatgatttttaaaaattttattcatctttattaatcttgatatccttctagagaggtgtgccacttctttagagacatctacttcactatccgaggaggaggaatcatcaattgctcctttgagcgtaattgttttcatcttttgggaaggctcttcatttgctcgagagggcacttcctccttctccttgatcttcttctcatagaccttgagcttgccaatgagaccatcaagtgtaaatgttctgagatcattgacttcctcgatagccgtagttttaggctcccatgccggcgttaaagagtaaagaattttataattcttctcttggttctccaacaccttgtcaaggccatgcaattcattaacaatgttagtaaatcgagaaaacatggcatcaattgactcattaggaagcatcttaaataactcataatcatgcatgaggctactaattttgaactctttgacttgggggttccttcatgagtaacacatagtttctcccaaatcttatgtgcgattgcacatatggagaccctattgtactcatttggggtgagaccacaaatcaaagcgttcatggttttaacatttaggttagccaaatgcctttcatgcttggtcatatctttactagacttctcaacatatttcttctctattatttctaggatgtcaagttcaatgcatcgtaagtaaattctcatcctagctttccaatatgcaaaattattgtcggtgaacaaagagggtatagtggtggattgaccttcaagcatatgcacattcattgtagaatccatttggatcttttctctaaggtgttagacctaataaatatgtagagaccttgctctgataccaattgaaattaccttaagggggtgaatagggtaatgtgacaataaatgtgcaattaaaatttgtcaatgtaacacaccaaccaaattaaatgcaaaggcaataaataaagaaagagtttagagaatagttatccaatagtgacacacgataagttcacgaggttcgatcctccgacctacgtcccgaccacctctcccgatggtaactttactatcacacccggtttgaaagccggaacttcttcacaatgatctccttttaagattttacaatccacacgagtgatctcctcgagatcaatctcaccacacaatcacaatgaaagaatgaaaaactctcacaacaatcctatgacaaggatcaagtgaagaacaagtaaagctcaagggttgtggagtgtggatgtgagaaaaacaaaggattaaacacaattgaggattaagaattgaaagtttgagcttaagaacacttagaaaactaaacttaagatttttctcttgctaaaatcattactgaagtgaagagagcaatggggtatatataggaaccccaaacaatagcccaaattccaaacaagtaccaaaatcctgaaaatcaactggtacaaaaactagccattatagaagatccggtcgatcgatggataatgtccggtcgactgaatatttgaccgttgcagactcagcaatctggaactggttcggtcgaccgacaatgatgttccggttgactgacccttagtcatcgatcgaccgcgcaatgtaaatcggttgaccgcaagtgactatttgcagggtcatgaaaacagcttctctagttggtcgaccgacgggcaaagcccggtcgaccgaaaacatgtacatacaggaatttaatgttagttgaaaatctgactttgtaaaatcaaaataaaatatcaaataaattccaaaaattataaaactttagaaaatgcttataaacatgattttgaacatgttagaacaagaatttctgaaagatcattttccaatagtaaaactgctcatttttcaaaatagttcaaaaacaatgtttttgtgaaaatgtatgttgaacccaatgagcttcaaatgttatcaactcaataacttgtctacatcaagcacttgagagaaagagaaagatgcaaatatctatatgaatacaattctttggtcttgatatttgctcatattttgatgaagcttctcttatgtattgtgctcttgaaagctttgcttcaacacatttcctccacctccatggatatcatcgttgagcttgattccatccaatcctccaacattaacactaacttgcttgataaattataatctacacaatataactcaacaagcaattagcaccaataatgatgtttgtaaatcatcatcaaaacaagagaactaacagcaagtgctttacgatcgagcaccttccacttatcatcgtccatcttctcaggtttccccgcctctacttggaggggtatgaagagatccttttggtacaaatagtctttcatctgcatcctctaatacctaaaattttggccgccgaacttttcaatccgaagtatgttatcttcaactgtagatcccatagcaaaagattccgtctttcccaaaccgtatgctctgataccacttgttagggtacacgctaacaagaaagcctcaaatggagacgcaaaacacacccaaacgatcttagaatcacataatagaaccaataaacacgaattcaatcacagtactcacagatataacgtggttcactcttacggagctactccacggtgcaacgacgacgcccaattcctttatattcctttcgaggttacaaaaataaagataaaagagaacaccctctcttgttcaatacactctccaagaattcttacaaactctctctcaagacctctcaatgatatcacttatatctgtatctttctctttctctctctgctactgagataccttacaaatcaaacttagggggatatttataaattttctcatgggggcaggtgaacactatttgggacaggtgaacactgtagcagggggtaggtgaacattgtagcacgggggtaggtgaacactgctagctctttgatgagaaggctatccactctctcaacagaggtaactgcatttatttcactagaagattacattgtgaggaagatagtggaaaggcaccatggaaagtgtttgatttgggtactcggtagggtgcggattttggtgcttccaaatgcctcgcatattgagaatcctcagcaactattcacgccaagcttatgttagtcttgtgacctcattgactggtcatatttcagtattttttttttaattctcgtttggaatgcttgtttaaagaattttgctttgatggtaatgtagatttttatttcaattatatcatgttttacacataccagaatggaaaacgctttgacaattaatgacatgaagtttgcataaatgaacaaatttgcacaagtgtacaagtctctcactcatccgtagtctttctcatgaagctatcaacatataaacctcatgaatttccacattaattttataataaatttataacaaacaattactttgagcaggaattggagaaacacaaccaccaagcacagacttgcacatgcaaaactactaaaggaaacaatttgaatcataaccatgtgaaatggaagaagatatgaaccttgtttccatggaaaagcaagctattttcccttcacaatttatgcctgaaacttgcagctttctatttatggagttaacttacagtaggaaataaatgttgtaatgtgaatgcttcattttttagaaaatcatgtgcagtaatttttagaactattgcactcatctgtcttgctttgtcttattagttatttctttgcttcaacaacggaaactgcagtatcagaacaaaaatgaagagaactactgtaagtgtaaactgatttgatgcactacagctgtattggtgacatatgaacaaaaacataataaacatgtgtcatgtttactaaaaagacacaaataattagtaaaagaaacaaaaatcaagctcaggtcagacaacgatattcctagcagttttaggaccaacaatagaattgataccctacagtgatattggtgatcaacttgaatgaagcacaacaattatgacctctgttaaaaagaaaattgatacaaaagcgaaaatgctacttaaaaaattagctaatgctgaaatatacttaaaggttgtaaatacacaagtacattacagaaatattaaaaagaaagacaataaggagctgcataaattcacatggttcaatggctccattcacaccaagtaacaaaagggatttagtaaatgtattatgagaagtagactaatataattctcgatcgcaaatataattaaatctcaaatgatgcatcataaatctcacactaaaaagatggtttcaaaacatttcattgtaatcatacacattaatagaactatgcaagaagtataagtttgaggaataaacatgaaatctattatgagggtggttgaggttgctgtcaacattaaagaaaattaactatatgggcttccttgtctttttcactcctcaattaggagtgaaaaaacaggttttaatttgtttgaatgtacaccagacaatgaagctatattgtagctaagtggaatagagaaacaatgaggtaatcggatatttactgcaaaattatggtgagcattttaccataaaagtatttgggctacaaagaacaagcaataaaataatagctgctgttcatattcactgaccagagaaaaacttaggattaaacatcacaaggatatattacccgtgtaaaggctataggattgttaacatgaagaagaaaaagataggatgctaatatcgctagtatgtatcaaagaagttgatgttatctattacattgtcaaaggctatataaagaacatgttgttctcaagccacaaacaaagagttaaatttacactggataccattagttgtgctcctccactctcatagtggagaagcgaaattaagcacagttttctcacactaaatgctccacagatactcaaaccccagcacgaaaccctaccgttgagatcaacatttatgaatcccgggaaaggcctgcaaagaaagactgagatcagataagacaaaacaataacaaagttttggaaatcaaggaataacagagaaaattaaattggctcgaagaactaatcatttcttgttatgtgatcgacactaatgcatttgcatttattggttgccagatactatgcattaaatcatgagcagaaactaagagtatcactacactagaaaaaattataactggaagtaagacatggaactgaacatttgaaagacaaacaccctcaaagagccactatttaaatgtaattaaaacatagctcccagattccatttgggtaatgcaaagggatgccttcaagcttctcttattaaatggcacccgaacaaaatccaagatcttgcaagaaaggcacatggttttattaatatttgacttgggcacagaagcaagaacaaaatccaagatcttgcaagaaaggcacatggttttattaatatttgacttgggcacagaagcaaccaagttgagttcagggtgtggaaagaataaaatctgagacattgttacacattacctttttaaagccatttttattcaatcttgagcaaaaaccaaaaaaaatatgaagctttttcagttgatattagcctattcatccttgtcattgtctcaaattacaatgcttacagccacacagccatgacaaaagactgggatcaagactggaatcatccatacattttcgagtatgagagttacattaactacacttattataagaaaggatgccatagattgtttgagtgatggtgagacctaatactagagctcctacaatgagtgagcaagttacccatggattcgcaaagtatctctgcttaaagttggcttgccacctgttccatcttctattgcaatactcattgatgtccttggttacatcaacatcaacattgtcgacaacttttgcaactataccttttgtcagtccattaaaaagatcggctatcctcttatcactgcttacccccgacctgataatacccttctctcgaagcaaggcaatatctttgtcattgtttacaatgccatccataacccgacctgataatacccttctctcgaagcaaggcaatatctttgtcattgtttacaatgccatccataaaaaacacataggatgttacctcttgaccttcgccatgtgcttgctcataggcaatgagattccgcataacaacttcaaatgcttcgtcaacgtcgactgcaggtaggcaaaggacacctttggtgaagcatatatctgtcaatgacagcgtttcactgcactggaaaattacgcccgcctcctgtagttcaactgccgatagtggttggcgactgctggtgtgatgataacctccatgctgtataagagtttttttgtacacatccagtaggtgatgccctgttatctcgggtaggtgaaatatcgtagaggtttggctaatatcatatcttccctcttcatatttgcggaagaagaaatgtctgatcagctgatgaatgctttggatctggaagacagaaaaaagttatttgctttaagcaacagcataaattacgatagctttataaagggatccatacacaaagttcaacacttaacagcaaatagtgtcttctgcaggatttcaataaagtttatctatccagaagttatttatccaggtcttagttcaatagagcatatatgatgtatatgcaaatagtgtcttctgcatgatttcaatatggtgactgctttcttgagcatgcacattactcatttatttgcaaaaaaatctcatgggaatgatatcttcaatggatagcaaattttgtgcgagtatcctccttgcataatgtatcatttcatacaacgttgactgttaggttaatcttgcattacgaggtatgaaaattttgtgcaagttcttctggagttacagctgggacatttcaaggtatgaagatttagatttcattaacattccttaccttgttcttgcagaatttagacaatatctccaggaccttcattggaatttgattatccaacctgagcatatctacacgaagatcttcgaccaagtatggcttcttgaatattgggtccttggcatgatagctagaaggtgtgcgctcatatggttcaacggtcgctatcatgatttcaatcatgaaagccccatcgtaaatcatgatttttaggaactcatcatcattcttcatccaaaaggtgtcaagatcttgatagcaggctctgaaatcgtgcaggttcttcctcagggctcgtatgatgtcatggatcgacacttgacatcggatgaggaagttcagtagcgccctgtgtttatgacgttccatacgaaggagattcagatctccattgtaccgtggtccaatgctgcacgttgatggcttatggatctgtgggctaatccttttgaatgtgtctggtacgtcgtagattgaatgacgactccaggcctccgccatcagggcatttgtgctattgagccaccctatatccgatgtcaatcgagaaacccaggcttcagacatgttcttgaatcttgttcaagaaggtgaatcttggaacttggagaagacaggtttgagaagggagctcgaagggaggcgaatgcagagggctgatatgggaccggcgggtttgctgtcaggagatggtaattgttgtgaaggtgcatatgaggtgatgaggtttatcgtctctatgaatgttgtcacctggagttgagttcgtgtcgctagaataactagagggtataaaggggaggttcagttaatcttcctccctcaccagtgaaatggaaaataaaagcctctttcggcctcttcctgttattaatttttctcttctttttttttcggttttttttcttttgttttgcgtttggttaggagagcaagaatttaaaattgggaaagttgtgtgaaggccctaaaatttaaactttgatgtgtctcaagccaccgtattatttccctcttgtattttagccccaaatacattgcatctttttgattcagccctcttttcactctaccccaagaaatgtcgtttgagaattccgaaaagacccctcttcgatctcataactttcgtcccatttgtgattcagcctcatctctttctactctctccttagcctcctcctctccctcttcatcttctccttggcatctgccgtctaactctgtcgccttgcccttcgccactaccgaccttgagctcatgctcaacttgtttgacaagatcttctccttcaaactcgctgccatctactcctttctcgagctcgtcgtcattctcaactttcgattcaacctcctctcctactttctcctaaccctcctcctctccctcttcatctttccgtcgaatcccatcgtctatctctccccatcccccagtgccaacaccaccaaccttgagctcatccctactagttcgacaagatcttctcctccgatctcgctgccatcttctcctctctctatgactcagtcttgtttattttattcttgtagaaactgtaaaatttatgtttcgatgagtgagaacggtagaaactgatgatgggtacaaattatttggaagaagttgataatggtcttagttgaaattttagagaaggaaattttttcttttttccttattcctgattttttgtaataatttaagttgggggaataggacgaagtttcctcataagcttgaagaatgtgattatcgtgtgacttgggttgtaagcgtagaatatgccttttttcctcccacaaacaatggtaattttgtgtgctaggaatctaatgacttgtaaagttaaaaaatcgagaaaacagtggaattgcgtataatatagataattgtgatggattatttggtgaaaattggagatggttatttgaaattttttggggataaaatttctttcacttgtatggttctcgtgttgttgtgaactattaagaataaaagtttactaaaaaattactttaaagcaaaaaaaaaaaagatggcaaagctttactagcactaatgttgaaacccaggattagtttaccgccatgcttgcttgcaacaagcccataaaaataacatggacttttaaagataaatgcatatgtttaggccaatccaaaaagcccgtcagtccgggcccggtccggggttggccctttaaagcaaaaaaaaaaaagatggcaaagctttactagcactaatgttgaaacccaggattagtttaccgccatgcttgcttgcaacaagcccataaaaataacatggacttttaaagataaatgcatatgtttaggccaatccaaaaagcccgtcagtccgggcccggtccggggttggcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcgatttggcgatttggcgattttggcgattctgcattcccctgttgtggcttcggccatgcaaggccgggattcatctaatcttcaggatagcagagcttttctcaataatgaggatgatgacctagattggattaatgtagtgcagcgtaaaagaaggtatcgtaaatggcgatttggcgatttggcgattttggcgattctgcattcccctgttgtggcttcggccatgcaaggccgggattcatctaatcttcaggatagcagagcttttctcaataatgaggatgatgacctagattggattaatgtagtgcagcgtaaaagaaggtatcgtaaacccttacccaaaccaattgattcaaaatctaatgctcatactcgtattcaaaatgtttcgaacaaggaggttggaaggcatcatctagcagaattaaagggtaaggtgttccaaaaaccaaatctttctgactcctggaaatttaaatctggtggtactacatcatggaaagacatttgtactatgggacgtgagataaatcaaagctgttctttagaatactttcctccatcgattgatagtaatggtctccgttatgcatctatacctagatctgagattctccttaatgtggaaaaatggaataacactttagttggttatgtcctcggagataaacctttttattcacacttgaaaggatgtgttggtcgtctttggaaactttcatgctcccttgatatttattctagagagaatggtttgaaaggatgtgttggtcgtctttggaaactttcatgctcccttgatatttattctagagagaatggttttttcttctttaaatttggttcaaatgaagagttaaacaaggttttaaatggtgggccttggttgtttgatggcagattgattattttgaaaaaatggactgaaaatattggattagaaagagaacttcttaactcagttcaagtttggattagatttccatcgctgcaccttaaactgtggtctaataatattattgggcgtattgctagtcttgtgggtaatcctctttatattgatcaagctactgcaactggtgagagactagcctatgctagatgctttgtggagatctcctctaacatgaagcttccaaattctgtaaggttggatctcggaaatggagaatggttagaaactattgtggagtatgaatgggttcctcctaaatgtggtaaatgcttaaattttggacatgttgattatcaatgttctgtagaacttgttgagaaatgggtccctaaagagactgtaaataagaatgaaaaggaaaagaatgatgcaattcctattacagtattatcgaagacagacatgattgacaatcagcaaaatggtattccagatgttattcctaccaattcagggaatgttattatttctgggtcaagttctgataactcaaaaaatgttattgatattgatactcctctggtagtagttccatgctgttctgatacagataatgtaaatacagataatggagttcatttaaactctatatcttctacaaaatctgattctatctatacaaatgccatttttatgaaagttaatattaatgcagaggatgttgttattaaagaaaatttttctcaggaaaatcaggaggttgatgataatgaggagctaccaaataatgaagatgcaaatgctgaggatttgtttcatgataaagctattagaattgatgtccattctggagctgcagtcttattaaagcataatgactacattgatacagaaatgaattctgataatcatactcataccaactctataaattcaggttttcaagatcaacccaaaaaaagcataggaatgaatatatctgtgcaatccgatggggaaaatgggaacgggacaggtattgattttcctattgcaattgataaccctgattggataaatggtaaaaatcagctgttgatgaagaagaaaaataaccaggtgaagataaatagagattcttctttaggccctaagagagttacaagggcatcatcaaatactacctcatgacaatgctattctggaatgtaaggggcatgaataatttgagtaggagaaaggatattaaaagacatattaaatcattgaatcctagtgttgtgggtttgttagagaccaaagtaaaatctgaaaagtcttacagggtgtccaaatgtatccctcctcactggtcatactgtaataattatactgcttctagtagaggaagaatttgggtagcttgggatgaagaggtctggaagggtacaattttatctattactttacaacagattacaataatgctccagaattgtggtggtttcaatctaatgttgagtgtcatttatggagaaaattctgaaacattaagatctactttatgggctgatatttctgatatacactctcaaattaacacaatgccgtggctgttagtgggggatttcaatgtttgtagatacacatcagagaaaattggaggaaggaagctaactgcaaggaaactacaagacttcaatgattgtatacagaaatgtggactgtctgacatcaaaagtaccggttcatcttggacatggcataataagcaacaaggtagatacagaatatatggtaaattggatagggccctgagcaactcatatttgataaataagtttcctcaagtgtttatagaatataaatgcacttcttctagtgatcacactccagctcttgtccatcttatgcccagcactctttcagagccaaagccattcagattttttaactactggactcaatgtcagggttttgaagatgtggtcagtagtgtctggaacaattttaaagcaggttctccaatgttcaagttagtttctaaacttaaggatttaaaatccgctctcaaattttggtcaaaacagtcaggtacttcaacaaagaataatattataaagctgtcaaagcagttggagcacatccagaatgagctaaataatgacatggaaaatgaggacttgcaatctactgaattagcattatgtttcgagctagatggatggttaaacaagggggaggatgagatgaggcagaaaagtagacaatcatggctacaacaaggggatagaaacactcagttcttttataatgctatcaaacaaagaatatctatgaatagcatacgacatctgattgacaaagaaggctctcctatctcttctattgaccagattaaactaatggctccaaaattttatgaagatttattcaatcaaacctcatattggaatatttttcctaaactgacagttaagagaattctaactgaggaagcaaaacaatggttatgcaaggatataagttacaaggagatcaaggatgctcttttccagatgaatccagataaggcaccaggacctgatggttttaacgcctatttttatcaacagaactggagtttaatcaagaatgatgtggctctggtagtgaaatcctttttctcatcaggtaaacttcttaaacagatcaatcatactttcctcaccctagtaccgaaatcacatgaagcatcttccataaatgattatagaccaatatcttgttgcaatgtcatatacaagattatatctaaaatcttgagtaatcgtcttaaattggtggtgggagaattgatatcaaaaaatcaacatgcttttctgcaagggagacatataggtgaatgttctttattggctcatgaattgctaagggatttctctaagaatcatgggaaaagagcttgttttaaaattgatttgcataaagcttttgatagcattaatagagagtttgtatactatattatgcattgtatgggttttccagtcaaatggatcaattggatcaaggagtgcctgtcttcagcaactttctcagttcttttaaatggttcccctaatggtttttttcagagtaataggggtattaggcaaggagaccctctatctccttatatttttgtattagtgatggaattctggtctattgggatggagctagctacaatctcaggggatattcaaaattttaagaaaagcaagaatctgcaagtttcccatattttgttcgctgatgatatgttggttttctgtagagcaaatagaaaatctttcgaaggtttaaacactctgttagattctctggttctccatactggtctgagtatcaactgaagcaaaagcaggatattttacagcaggggttgtgttaatacaaatgatctaagctctattgtgggaatatctagaggaactctgcctatgaaatacttgggattacctctatcaataaattatcctaaagctaaagattttatatccctaattgataaagttagaagtaagattgaggggtggatgactcataccttatcatttgcggggaggcttgagctcattaaagcagtcctgtatagtaccacatcttattggttctctgtttataactttcctagctctgttgtacacattttggaagctatttttgcaaactttctttggaaaggtaagatgcatgctattaattggaaaaaagtttgtagaccaaaagaagaaggaggatttggtcttagaaaacttgatgatctctgtcaggccgcaagtttaaagttgatttggcaactccttactgttaattctctgtgggctaattggatgaatacaagatatataaaggatgttaatttctggaatacttcttctaacttaatggattctggcacttggaagcatctttcagatctcaaaatcaaagctttgaattgcataaggaaatctattggaaatggggagtctacttcactctggtttgatccatggattcaggatggcagaattattgaattattatagcatcatactcctcaactcactggcactgagaactggacagtttcctatattatacaaaattctcaatggaatatcacgttaccttgtcttatgcctctggtgaatgtaattactaaaatcaaaatttctggacaaagggatcaatgggtttggctacctgcagctagtggtaagttctcttttgcttcgacttgggatctgttagaccctagaaggggggggggtgattagggtcttatgctaatttaatccgattaaatgccaattaaaaactaattaacaagttatcctagcaagtatgaaatgcaacaatatatatgaactaggataagcaatatacaatatgatatatcctagcaaagaggcatatagtgaaatatatgcaaggatatataaactaacacaaggggtaaacaatctaaacaagatagtggatgatatagataatgagctaatgacaatggcgatataagatatgaacataaatatgaatgaacgccaaagcacactcaaacaagcaatatgatcacggaatttggacattccgtcctacgtctccgctccccactcccggggagaaatccactaacacaatccggtttggaagccggaacttcttctacacactcggttttctagctaaccgaaaactctcacacaacaaacactatgcaatcacactctacacccacctcaaaaggttgtgtgtgaacaaagagatataaatcaaaactaaactcaaagtagttctagcttaataacaatgataatcaaatatataaaagagctagaaatagagtttagaaaacttctcaatatatcaagagtggagggagaagagttggatgcacaaacgccaatagatgatctcctcaagctcttgttgaattgaatcacaaaactgaaacactctaatgcttaaaagcttcttaaaacaaacttaaacaaacactaaacaagtttaaacccttgttaaaaactttttaaaccattctcttatatataagaaaagagtgcaatgggggtatatataacctcccaagaactcagccaaaaaactgagcaaaagacaaaacagccccaaggcaacggtcataaaaagagccgttggaactgtactggacaggcgtcggtcgaccgatccggtcgaccgaaaaagctctcggtcgaccggaccggtcgaccgacgaatctctggaaaaatactgacgaatggtcaattgaccggtcgaccgtaccggtcgaccgaaaacnnnnnnnnnnnnnnnnnnnnnnnnnnnnnnnnnnnnnnnnnnnnnnnnnnnnnnnnnnnnnnnnnnnnnnnntccaaaaactaagaaaaccatattttcacaaaattgcatattctatgcaatgttttcaaaaacacaatagaaaatatgaaatatataatttcatatatataatcataaaaactcaaaacacatgtatgtatatatataactatatatatagaaaccaaaacttatgtatatatatataactatatatatatacgaagaaaccaataaatgtgtgtgtatggatattgagcttagagtatataacacacataatataaaatctaaaactacattacccaagcaatcttgatcttcaataagcttgacttggtacacttgcgaatgaagcttgaacttgatctttaacttgaattgaataagcttcaccgacattccgccaacctcctttggatatgatcgttgaagctctattccatccatcctccaacaacgttgtttgtctacaaaacataggaattcacaaacactagacaaacaacattagtaataaattgtttgttaaacatcatcaaaacaagtggtaagttctcttttgcttcggcttgggatcaagttaggactccctacgataggtttgagctttacaatgtgatttggttcccttcagtaaatcctaaaatggcctgttgtttgattaactttacaatgtgatttggttcccttcagtaaatcctaaaatggcctgttgtttgattaaaagtctatacaatagactggctactagagacaggctttcaaaatttgggatctcctcaatggaggattgtgttctttgttctggtgagaaggaaactagagaccatctcttctttcaatgcccatttacagcttttatttggaaactctgtaaattaaaattgcaattggattctactgttattcaagatcttagaactgaagcgctgcaaattcaacagaaattcaaggtgaagaatagaacatacaaactggcaagattggttttaagtgctactgtgtggcatatctggcaagaaagaaatcgtcgaatctttcacaatcaaaggatgcataagattttggtgtttaggagactttatgaagatataaatgttcttctgagaacctgtaattggaaggcgggaaatgaagctgttctagccaattggagtctggaaccaattagtcgtgaacagtgatctcacgtagtgttttcgagttttatttgtgtaaggggcagtactattttttctcttttgttttggttttgggtaatactgtttttcctttagtttctttagttgagggtgacggccatggtcctcttccctctctatagtttctaaggtttgattcagtgtcacccagccaatttatgtaaatatgtactagcgttatgatattaatgaaatacttatctttcaaaaaatatatatatatatatatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgacccctacatcacatctcaaagatagagccttaaccacctttcaccaactcaaatatagatgtagggtccagattaggccacataactaccaagttacttggagaaaactagtacaaagtttcttcattgtaaggactgacccctacatcacatctcaaagatagagccttaactatctttcaccaactcaaatatagatgtagggtccagattaggccacataactaccaagttacttggagaaaactagtacaaagtttcttcattgtaaggaccatgattttttaataccagttaaaataattttttagtattttaaaaaatatttaattattatttttaaaaaagtatttgtattttctcgattttctaggattttctatgatttaaaatccacgttttataattatttaaatgatttagatatttataaatttatttagtgcagtaaaaatttttggattaatctgttgtgttgtcgatgctattacgtatcatatttaataatatgttgtattattaatattattacgtattatttcgtataatactttgtattattaattacgtattatttgtataatttgttgtattatttctactattacacattatttgtcgtattagcataactggcacgttttactgtgtatataattatcccataattatttgattttaaatgtaagtaaatatatttttattattatttattcttgttttattgtacaatatgtgtgtattccgactattttgtatcaactgttatattagcacaataggtacgtttttatttgtagataattactttatgattagtttaatttttaagtacccgtatttatttattttaattatttttgtttcaaatacctaaccaaaatcctaattaatttacatataaatcctcttctctctatcacacacaaactcacgttctctcaactacccctctcacgttgtcccaattcctctctcctctaactcctcagacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagaacttgagcacccatcccctcctccaccagattccgtccgccctacctccagatccacctccttccctttcgcctacagtcgccctcttcaaccacacccccgacctcctcttccttctcctccacgttgctgccccaagcccaagctcctcgtccgtgcctctctcctgcagctcgagccccactccgcctgcaccacctccagctaacccnnnnnnnnnnnnnnnnnnnnnnnnnnnnnnnnnnnnnnnnnnnnnnnnnnnnnnnnnnnnnnnnnnnnnnnnnnnnnnnnccataccctctctctcctcccctcctccactcacccccgctgccccctttgccgagccgagcaccaccacccaacgcctcctcctccgctcgccgacgactcgtttgacagcccctagaccgccatcaacctccgcgcaaccgcttatcgccgtcgcctcactcgtagactcgcgcgtcgacgtcgaatcgttcgacacaatccgaggtaagatccctatccccggttgtttaattattataaatttcaaatttatcatatgtttattagcagcaagatccctcttctcgattgtttacttattataaattttagatttatcgtatatttattaggagcaagatttcgttgctcaggttgttaattacacaattttatacttgttatgaattatctgcatattaatttgtgttataattatctgtgtgggattgactgatgattaatatcaaataatttatagtaatatgatgagtaatactttcagaagaattatagtaaattatgagaatttatttggcaaaagaattatatttttgataattatgataattttaaaggaatgattttggaaaaagaatcatttttgataattatgatgatttaaaggattttatttgtaaaaaaattatcttatttgtaaaaaaaaattatctattttggattttaagtaatttatgattttgtatgagtagtttagagggttggataacaagatattgataaaaccggactgtatgtatgtttttactctttatgataacatttcacgttttgcagttatgtaatgtatttgacatgtctgctatgtattgtccatgctgtgtttgagaacccttagtagttcatgacatgtgtgggtgtgttgactgaatttaggtggtgaacccaagtttcaatgaggtttatggttgatttagaaagacgagaagagttgggatggggaagtccatgttcatgtgatcggataaggttgttgatgtatcttccaaacttacaccagtgaaccgtttcgcactggggttagtttgttaggccaagtgaactgtttcgcacttggtcagtgaaatagtttcgtcacctgagttttgcttgagttagaaccagaccaaaatcggattgcgtgtagtcctctcaccgaaccgtttcgcgggtttagatgcacgtaggggagaacagccagttatccggtgatataagtgttgactctgtgtgagatgtggaccaatgacctgttatagaatgactagttacatgaccttgttacttaaggtgattaggattcttgtgtgagatgtaggtcggttgtgtttcttttcatacatagatcggggttaatatttagttatctacaatttgagacatatgatatatacatgagggtttccttatttggattattttgctcgacatactacgtctcttgttgtagatttttaagaattaattctatctagttgtatgacatggttacttggatgattgctgattgctagctgcatgatcgacttgttacttaattgattttgttggaattttagttgtgcgtttctttgtcatttctattgttgtatcgtttctcgtattgggtgtttgtacgttctttcttttgtggggtcttttcatgtgccatgcacgctgacgtacacctgttttctctggtgtacgtcagacttagaggaagaacaggttcaacgggagccagatgattctcaacaggagtgctttgtagacggagcagaaggagtcgaagcctattctttttatttattagttgatgattccagttacttttgtagttctttctgtaggcatataaaattgcttataggtcccttagctcagctcagcacaaaccgacaaaccaacgaggcgacgagattgactaatcgcacgcaagcaacggaatacgtccattcgcgtgcgggatcaagccaagtgttcgaagagtcaacgagtcatccaaccaagagcatactcggacgaaccacgatcgaaatcgggatccggatttactgccaaatcaggtcaacaaatcgaatccgaaccaatcaaccacagaaccggaaaacgggcacaaagaggcaaaacgacaaacacctggaggtcggctcaccgagccaccaaggaggctcggtggccgagccaccaagtggtggctcggccgagccacctaggtggctcggtggccgagccaccttggggtggctcggccacctccgagccaccaaatggtggctcggaggccgagccacctccttggtggctcggcggccaccaaggtggctcggccaccaccgagccaccaagaggtggctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaggatcagatctcagatctacgcaggcatactccggatctaagcttggtcttagatcccgagacttggacgattgtttccttggtgaaacaatcctccccggctattatttcctgggtgaaataatacccgtcgtattgcgtagatccgaccggatctagatctcgcggtggtccacggcaaataaccccggcgcaggcagaacccacacaagcgagcgaccgcaaaacaggagctcgtgattcgttcgactcttccaagagaaaacttcgttggtacgaagaagttgaagctgccaacgaagatctcgccccgtttgatgccgaagctgcatcgggtgagatctctccttccaaccaggtcagatctgctctggccgaatcttccgttgccgagggcgtagtgactctctcaaagagagcccgccaaaggcaacgtcagcgccttgcgaaacaaatcgcaaaggcaatggaatctgtggacgggatccgttacaacacggatctgaagaacagaagaggcgaacgacctcaacaaccaatgaatggcaactcctccaagccaccaacgaacgaatggatccgtgtcaaacggaaccgttcaacgctggaggatcgcattcagaagcgccgcgcactctcagcacaagcacgagctcaagttcaagaagcccgtagaaggtggcagaatggagtagccaagaaatcaccactaactcacaaaatatggaggccaaagtccaaagtggtgagtcaggccgaggatcgacctttacagccttcaaaacgagttcaacctcccgaaccatcccgaggaaggaggtcaatcttggagcgcctcggtccaattcccgacgagcgcaacgaagtccatgaacgctcgggcccgatgaagaggctccgaactaatcaacatgctgggggtcgacacaaccctcaacatgacaaagagtttacggcacccaagcgcactaccttgcgcatcgaagttcgggagcccgctgagaattcatgtctacaaaggcgtgtttcgaggcgagtgactctcggaagtccaaataaggcagtttgctctcagaaggaaacgttgtcatccgaggatgataacgttatacctgggaaatcatgccaacacgcgataggttactccgatcaaatggacgagttgtactatcgtgctgggggtacgaacaaaacaagaaaaagaagccctcaagggctcgaaactcagtgcccatgtgccaagctcattcgggtagtactgtctcaatgcaactgcatcaagggagtccccgagagaatttcagtgttcgaaaggctcggcaccgaaacgccaaaaccaaggcataggcgcttccggcaaagaagaacagtggttaaggatggagaatttccgaaggtcaccgccaacatgaccagcaaagagacatcgacacagattgatctcaaatcgtttctggaagcgtcccggcgtgtaacccgtctgcagtccggagccatcgcacgaggaacttatggtagggttcggataagattgccttcggaagatgaagaatcggattcctgctctgctgtcgcatcggacaatacagtgtccagcgaaggacaaccccgcgagtcattcatgataggcgcggaagaaatggccaaaatgcttgaagacgctttggctaagcagaaagaaagttttaaattcgagatggagacggccatgcagcagatgagagagatgcatgaacagcaaatccaagcattcaggaaccaacaaggtgaaccaagccaccgtaaccaggttgctcaggaaaaggagcacgcggatggggatgaagctcacaatgccaataaccctcccatcaatgcagggggtggtagtgaggatgccaacggggatacaagtgaagacttgaagatcaaaagcctcgagagtaaaatcaatacgttgctgtctgctcaagaggtaaagaaaacgggcattccttgtccatacccgagggaatgggaatcaatcccctatccggcgaagtttagtctaatcaacttcacgccgttcgatggaaggggttcccccacccagcatttgatttatttcaaatcgcacctgggtgctatctctgggaacgagcctctgatggtgcggtcattcgtcggcactcttcgcggagctgccttcgattggtatcgtcgcctcaagccaggaagcgtgaacagctgggatgacatggagacgaagttccttgcaaatttcttcgacgacgacaccgagatctctatcggatcgttgctcgacgagaaacaaaaagacggggagttagtcgacaccttcgtcaaaaggttccggaacaaggcgatgaattgccgggacccgatcaccgaggaattcattctccagacttgccacaacaacctcgcattggacgtattggaggcaatggggacagcaccgtctgacacttggaaggatctgaaggtgcgcggtgaacaagccgaacgcttccttaaaaggaagaaggccgaaaggaaccaaccgacggttaatctgctggactcaaacttcgcttcccgtggtaagggcaaagcacctgcagctgctggtggtgctaatcaagcgtcacaacagcaatcccgaaggcagcagaagacttcgggtccgagactccagagagagtattccttcaaggacgaagacgttccaaccatcttcgaatcgctcctcgaaggcaacaagatcaagctaccacctatcacgaatcaggaggaagctgataacactacggacccaaagtactgtgcataccacagaagggttgttcatcccaccaaggattgctttgctctcaggaatagcattcagaccttggtcgaagccggcgttataacgctaaggtaagccaaataaaaacggcaaaactccgaccggtataagagtataaactgcttcctgacactccaaagagtatacgagtataaactgtttctcaatcctccgaccggtataagaggttaaactactccctgatactccaataggtatatgagtctaaactgtttccccacttttgacgggaagttcctggagaatattaagctaatattcttaaggataacccggttagttaactgataataatgtccgaaccagttccgcagaggaaactgggggtggacgatttatgtaacgggaagttcccaaaaccacagcaatgtaatgaataaggactcccattcaagttctcactgtgtctgtgcactcaacactctctctgttagagtctggacgtaaagttcctgattggtcaaaccttcttacagttaggaccacagtcaaaatcccctctcgattctcccaatgaacgagaggtccacaaatcaagcgatcaaaccttcctacagttaggatcgtcttaaaccttccattcggtcaaacctttctacagttaggaccaaaaccaaaaacccctctcgattcctccaatgaacgagaggtccactttcaaatcgagtgatcaaaccttcctacagttagggtcacctcaaacctcccacttggtcaaaccttcctacagttaggaccaaaaccacgattcattctcgataaacgagaaattcatctttagttcgataatcaaaccttccgacagttagggttatccgaatctttttgattctcggagtggagatcccactcttagtttcacctttccggattctgggggtggagatcccacctcgagtctcctttccttctttgttcggggaatagaatataaaattcttccttccccataccaatccttttcgaagaattcaggattcatcctaggaagtttatcccgaatcctaagcagggataagtctgcgcctaacacgcgctgccggtttagtcttttttctgcacaaaaagacaccagagttcgattctggggtattctatcctgaaacctaagcaaggataagtctgcgcctgacacgcgctgccggtcagttcttaaccgtttaaaaagaacacccgttcacatattcaacattgtgacaggttgttattaataacaccaaaatccatgccttacacgcatggggaatttcatcctgaatcctaagaaaggatatgtcgacacctaacacgtgtcgccggtttagtcttttaccgattgaaaaagacaccagaataccagtctggggtatttttatcccgaagcctaagtagggataagtcaacgtctaatacacgttgctgggtagcctattcccataacaatggtaaagcctatgtattcaacatcatagcacaaagtctaagagaattcactctcttagcacaacgttacatgcggaacggatttcgtcaatccgcatgctagcccgactcaaacggtagtcggtaaaggctaatcaaatccgttaaaggcttggggttagccaaaaatcctaaagtcaacgcctaacacgcgtcgccgggtagtctattcccgtgagaaagacgaagtctacgtattcgaagtcgtagcatcaagtctaagggagttcattcctttagcacaacgtcacatgcggaacggacttaagacaatccgcatgtaagcccgattcaaacggtaatcggtaaaagcatgacaaatccgttgagggctgaggatttgccaaaaatcctaagtcaacgtctgatacacgttgctgtttagtcttttcacaggagaaagacgaagtctacgtattcaatatcgtagcactaaaagagttaactcttttagcataacgtcacatgcggaacggacttaaacaatccgcatgctagcccgactcaaacggtagtcggtaaaggctcatcaaacccgttaatggctgagggtttgccaaaaatcctataaatacgagagtcactgacgcatcagcttcattagttggtctcgtgacttgagcatccagcgacattcaaaaccctaaggttaacgccggacaacgcataaccctaggtcaacgccagtcaacgcgttgcaatcaaacagtcaacgtacgacgtccaaaaccctaaggtcaacgccggacaacgcgtaaccctaggtcaacgccagtcaatgcgttgcgatcaaaaaatcaacgtacgacgttcaaaaccctaggtcaacgccggacaacgcgtaaccctaggtcaacgcctatcaatgcgttgcaatgaaagaactaacactccgaagagtatatgagtataaactgctcctcaatcctccaacagtgcatgaggttaaactgcttcttaatactccaataaggtatacgagtataaactattccctattgttggttgagaagttcctggagaatattttcattcttaaggataactcaacaacactacgccggacaacgcgtcgcaaataaagactcaacgccgacattcgagggtcagttctgtgttcaaccaacaagcacgagctaaaaatcagaaaaccaggaattgacttcaagttcgaatttccgacaacggtcagacaataaatgcagcaccggaactcttacagactttcgacaaagcaccgaaaagcctggagaattgaaggagtcaagaacgggaatcattccaagatcccattacaccgactaaaggtgggggcaatcatatccaaagtattccagactcttctataaaagaacgagactgaaatactttggagggggtatctgtaggcatataaaattgcttataggtcccttttgctcagctcggcacaaaccgacgaaccaacgaggcgacgagatcgacgaatcgcatcaagcgacggaatgcatccatacacgtgcgggatcaagccaagtgttcgaagagtcaacgagtcatccaaccaaaggcatactcggacgaatgacgatcgaatcaagatcggtttcggactccaactcagaagcggatttactgcctaatcgggatccggatttactgccaaatcaggtcaacaaatcgaatccgaacctatcaaccgcagaaccggaaaacgggcacaaagaggcaaaacgacagccacctaggtggccggccacactgtgcctaaggcacagtgagggtagcctataaataggccacccccttgttcatttgagagggttggaaattttggagagaggcgaagccctgctggattggagactcggaacttaaaaaaagattgaaactttgggacttcggggactcactccttcagatctggtgctcggcgatcatcaacgtcaaataaggcaggtgttcgagaggatcagatctcagatctacgcaggcatactccggatctaagcttggtcttagatcccgagacttggacgattgtttccttggtgaaacaatcctccccggctattatttccttggtgaaataatacccgtcgtactgcgtagatccgaccggatctagatctcgcggtggtccacggcaaataaccccggcgcaggcaaagaacccacaaagcgagcgaccgcaaaacaggagctcgcgattcgttcgacataaaaggagaaaagttgtaatctttgtttatttttatttgattttcgttgtaaccggatcttataaaaagaccggatcttttgttctcttcagtattcatttgttcaatttggtaaaagggcattttgacccaaactttgtgtcttggattgtaggctgtctaaaaatcacaatggatggatgatccccattaagccccgacaatagatagttttgtatctcttcagtattcatttgttcaatttggtaaaagggcattttgacccaaactttgtgtcttggattgtaggctgtctaaaaatcacaatggatggatgatccccattaagccccgacaataggagttacaatcagacgacttcctaattactgtatctgcaaccactataaacatggcctcatctctgagatgattgatcttgatggctgcgacaacaacatgactaatattatattagcaactattagagatgctgatgagcagtgtaatgatttcagaaataaaatgttggacttagttggtgagtttcttggtagagagctgtgggcaaatattcatctaaaagtcactatggatgattgattcccgtcaagttccaacaatgaaagctacaatcagatagctttcatgcctacaaacgaaagctacaaatggagaacttttcacatagatcgagaagagttacaatacaacgacgcttccgacaactgatgaaaactctattcagcagtctccacaatttacagtgaaggttacaatctgacgactttcacaccctacaatagctaaagctaggattactgaacaacggtccttgcaacgctatgtaggagaggttacaaatcaattaaccccttctaaaacgcagaagtcatccccgcgtcataattttggcaatgcagacgaccctcgcgtttccaagctataacaagccaaacacgagcgaccctcgcgttctggaggttcaactaacaccgacccccgtgtttccaagctataacaagccaaacgtgagcgaccctcgcgttcattgatgttcagccaacacccaacctcgcgtctcaattctaagaggcgacgttgggttctgaacgccagattgggcgtttgactcgctcaaatacgagtcgaacggtttcagaactgtttccccacgatctgaggaaatcacgcccacttaggagtagatttagagggcagttacaacctcttatccacctataaaaactcaacaaactcaactgagttaagggctggctttttggaacagagaggcagcaacagagagaattcctgaggatctcaaccgcatagagaggcaggagaggcggatcttttggagatagaggatttgaattaaattcagaaaatcaaatctaagaagattcttcaacaacagaatatctgcttggtcattaaccgaattttcggttctaacaactctcttcacagagttctaactcgtccagagttcttaaactcgttaagagttacccatcaaactttccacagaagttcattgttcccacgagataagagacggtcagatcatcaacgaagagcaatttcgacgcaagcaatcgaaggaggcactccatcgctactgagaagaacccagttttaaacaaaggagagaaccaaattcgttctcttctcttttgtaatcaaattgtaaccggaatcaaagaaatacaagtcaattttcttttgttctcttcattgcaatttttccaacatacatggatgatattcatttgtgatatgtattattttattctgcgttgttcattatattcttgctatctgtgatcgggaacctgtgcctttgcattgtatttattttcagatgcttagcgtattggaatgagaagaaaagaaaagagaaaaaaataatagtgtatatttcttctcaatctaatacgtcacgggcttgttcacgttacgattcccggatattttgggaagcagggcgtgacaggtgtttttttgatagcccatgtaggtcacggtcccgagtttccactagtaagaatataacggacaatttagatacatatcatgatttcatccgtgagactattcttgagcccttatcctattttattaatagattttgtttcgtccctatcttattcctctttgactccggagttttccatggttcttgttcaatcgcttcgcgattaccccctctttgttgtattgatttagatacatattatgtgttattatttttacaattatattttttatttgacttatatattgtttagttgtattgatttctgcattatttattacattattttatatatcacctataatgttatattgtatgtttttattaaaaatatatatcattacttatacactttcaattgttcaaatcatgttcattaagtattttacattactttagattcacctatacatcgcatatcatatctgatatttatgttagaccctagagggagggtgattagggtcttatgctaatctaatccgattttataccaattaaaactaattaacaagttatcctagcaagtatgaaatacaacaagatatatgagctaggataagcaatatgaactaagggatatatcctagtaatgaaatatgctatgtgataaatgtaaggatatacaaatcatacaagggtaagcaaactagactagatagagggttaaataaacaatgagcaatacacaatggcgatataagatatgagcaagaaaataagtgtgctaagcaatcacaaacaaacgatatgatcacggagttcggtctaaccacttgacctacatctccgctcctcacctcaaggagatctccactatcacaattaggttttctacgtttacccgaataacgtttacactacacaatacgattttctagtttactgaaaactctacaactaacacactcttgtaatcccactctacaccctctcaagtgttgaactagacgtgtctcccttaagtgctcggatacaacctcttcctaggttcatcaactgacgccactcctcttgggatgatccccgactctcgtcacacacttctttcggtgtacaagtgtattacaaagtgaatctcacaataagcacaatacaaagtgtttgttctctataatggatgagaatgaattataagctcactctctaagttacacaatcccacaacccaattatactatgaatgtaaatacaataagctcaatggtagagtgtgtgtaaacaaagagaaaataaaatcaactaaattcaatatgaacactagcttaataaaatgataatcaaacaatataaaatataaagctagattgagtttaaaaaacttctcaatagatcaagagtggaaggagaagagttggatgctcaaacaccaatagatgatctcctcaagctcttgtgaaattgatttcacaaactcaaactctcaaatgcttaaaagcttcttaaaacaaacttaaacaaaaacttaaacccttattaaaactttgttaaaatatttcttagattgtaactagtagaaggggtttgagggatttatataggaagagaaaccaacagcaaaacccccaaccaaatctcccaaaaacccagaaaaagatttttcagattctgtacaaaaagagtcgttggagtaaacgacggtcgaccgtgaaaatctcgcggtcgaccgcaagccactttcgaggctcataaaattccagaaactttgacggtcgaccgtgacagtcgaccgtgggaatttttgagctgacggtcgaccgtggtggtcgaccgataaagttgttgttggttcgcaggttaaaaacaaaggcgcggtcgaccgtggcggtcgaccgtaaattgacatatgagaaaacaagtttgaaagttaattttctgattttaaaaccctgtttaaaaaatcaaataaattctaaaaaatataaaactttggaaaatgattgtagacatgataataaacatgctacaaagactggtttttaaaaaggacctcccaaatgaaaaatatcatcattttacaaaatagtccaaaacatgaaaatgtaaacatatgaattttgatattttggctaaaccatgttttgaaacaataaaaaataattttatagacttgaagaaagatgtatactattattatgaagtctataaacaatgtgggcacaatataagcacaatcaataacttcccataagttaatatttctagattcaacaaatattttaaatttagagcaccattgagcataagggaaatttctatattttggagcaatatttggattatagcctaaacaaaatacattcatattcatgatatatatgtgaatatatgcaagcaagaaaaatgtaatcataactagattagcacaaataagataacttggatctttaactcaaggcgattagtccttaaatcaaagggcactaagctctgatactaattgttagaccgtagacagggggaggggtgattagggtcttatactaatctaatccgattttatgccaattaaaactaattaacaagttatcctagcaagtatgaaatacaacaagatatatgagctaggataagcaatatgaactaagggatatatcctagcaatgagatatgctatgagatatatgcaaggatatacaaatcacacaagggtaagcaaactagactagatagtaggttaaataaacaatgagcaatacataatggcgatataagatatgagcaagaaaataagtgcgccaagcaatcacaaacaaacaatatgatcacggagttcggtctaaccacttgacctatgtctccgctcctcacctcgaggagatctccactatcacaaccggattttctacgtttacccgaataacgtttacatcacaaaatacgattttctagtttaccgaaaactctacaactaacacactcttgtaatcccactctataccctctcaagtgttgaactagacgtgtctccctcaagtgctcggatacaacctcttcctaggttcgtcaaccgacgccactcctcttgggacgatccccgactctcgccacacacttctcttggtgtacaagtgttgataatcacatttttgttacaattttataccctcattatctattttatatgaataaatataccattaataattattgttagattagtttgcacataattgaatgaaaatataaataaatattattaaatataaaaacccctcaaaaatctctcttctctattttatagcatttttgaatcccaaagaccatcaagaaaaatgattacactaagagttgaaatggacgtggatgcaaagagtggaatgatttggacttggttgctaaaaaataaataaataagagttgaaatggacgtggatgcaaagagtggaatgatttggacttggttgctaaaaaataaataaattggacttttatgcaaagctggaccggacttctgctgctcttcaaaatcaaatggaaatttccattggggccgaactggtgtttgaatgaaaacaaagccatcaacaaatgagcttcatgggccgttgctacaagtttaattctcttgtattttgaaaagcaaatgggaactatattgggccggaattgattttgaagaccggacatatgtttacttgctgcagagttaaaaaaaatcacatgggccaaagaaaaatcaattgaattcacacacatcatggccggactattttgctgcaaatttggattggaccagctcttcaatttcggttttttttgtgaaaatcaaatgggaactcaattgggccggctgctgcataaatgagaaccgaacttgtagaccggacttgtggttttcattttggaaaatcaacaaataaattgggccgaaaattgattgttgattttcttttgaaaaaatcatatgggttaaagaagaaccaaaaagcaaattcaaaggtggagattgtggcttggggctcaagacaaatccaatggctcatattcattgaagattactataaataggggtagagagtgaggggttagaggtgtgaaaattttgtaaactccttttggagaggagggctactcttaattgagaaggccttccaaaaattgtaactttagttgcaattaataaaaataattttttcctctttaaatttgttctttctcctctttgttgaatgatgaggatggagatgaagagcaatttgaaggtttgcatttcttttctcttttatttctttttagtaatttctttattattgcttattagttagatttaaattcatgcttgtagtgtagatttattttcttgtcttttttatttctttttgcactttaatttgtagaatagatttattttctcgcatttaatttttgtaatatattttgtagtgtagatttttattttctttgtagttagatttatttcttgttcatagtttagatttttcttttctttttatttttgtaattagttctttttcttgtttttatttcttaaagatgtgaatttaattcttgtaggaagtttagaattatatgaaactagtctaatttcctttatattgtatgaattattctcttgcacttaaaatgttcatgtttaggataatcaactagagaactaatcggtagaagaagaatttgataatctatgcttatcttaaatggtttgataggttatgcttatgaattctaggattattatcatgttgttgttcttatcatgaatagtaattttgacttagatgataatttgataggttacacttttcttaaatggtttgataatctatgcttaataaatctaagttgaaatatgataaaaagagaatagtttatattttgtaattgaaattggttagtggattatattctagatttcttacctcttttgaatccaattcatcttaactttcttaaattttctttttatttttggttttattttttgattttattaattcatatttcttaccttgtgatttcatttattctttaattcttcattctctcctctaaaattcaatttattatcttttacatatattcataacaatcactcaacaaaatcacacttattctttattcctaattgtcacgcacaaaatataagaaccaagtttaataatctcttaaaatcaccttcttcgtgggatcgatatctttttatactataacttgataaattgtgcacttgcaattttggtacataattatgccgcatcaagtttttggcgccgttgccggggaaggtgctaaaataggattttattaacttgattctttaacttgtgtatttttcttgtgaaggaaccgcttggagcttgaaaatcttggattgaagatcaagaatttggagcattgctttcgggtaagtcttctttctagttttcaattccaccctctttagctagcttcacaattagagacaattaggatttaaaaaaaaaagattttatttttgttgaccataataaaatccatctttcacttagatattaactaacaagataataaactcaaacaattttccccttctcacttttgattattgttgaccataattaaaaaatataaagattttctttttaccatcctttttagtcgcttttaatttctagggttgcatttcatatagtgtaggaattcaccaaagtgattgtagcacttgatttggcacacacttaaatcattcttaagggcaaaaccccaatcaagataaggtaagggatttcatcaccctttccttagcccacaaatcactaattcctcacttcacaaatccaagccttctaaaactcattagacgttggcccctaaggattcgagctcaataaggaacaagaaatccttaagtgaacggtttaagttttctcagaatagttggtgtctaaggcaaggtttaggggttgcgtaaagcgctccgcaaggaaagaggtacttaattgatctttgatcaccctctagtactatccttaccttgctaactacttgggtaaaactttgatcttttcactgtaggaattttttggttaggagctggtctagtggagttaggctaaaccctagggttagagttgattgaaaagtgattgccttgatttgttttagttaggaatttttctttttctttatcttctcatataaaaaaaaaactaatttttcttttgtttcttaaaaaaaaatttaattttcttaaaataaaaaaaaaactaattttctttctttctttaaaaaaaaaaaaaaaacttgttttggtgtatgcaattttgggttcgggataattttcatcgcttaatccgtgttgaaccaatccaaaaaatggcaaatcagcccgttcttcaggatatgtgttaccccaccagaaatgcaattccatcttgcataagactccccgaagtaaatggagcaaatttcgaacttagaccgtatttcattaacatgcttcccaaattcctaggtaatgaaacagaagatgcatatatatttatctcggaatttgaggaagtatgtattatgataaaaatgagagaattaaccgaagatgcgattaagcttagatttattccatttgcccttaaggacaaagctaaaaaatagatgtacagcttaccgataaattccatcccatctcaacttgggaggaatttgtcaccgtttttctcaagaaatttttccctattcacaaaacggtaaagcttaggaacaacattcagaattttaaaattgtcccgggagagccattctggaaatactttgaccgatttaaagatcttttaatccaatgtcctcatcacggtctagaaaaatgacgattgtgccaagtcatatatgaaggattggactattcttcaaaaacatctttagaatcgatgtgtcagggagactttatgaaaaaaaacgccgatgaagcttgggaattcctagagagtctatctgagaaaacaatgcagtgggaaaattgtgatgacagggtttcatctgttttccaatctaagtctagtggtttttccttggagtcaaacattgcgtctggagcgaagatggcgacgattatgcggaggttagaagccttagaagttaaggaacgagctccggctcaaatcaatcacatttctgccccaggatgtcataactgtcagtctcctacccacgtttcagaggaatgtcctcttctaggaaacaaccatgctttagaacagatgaacgctgcattccagcgccctagaaatgatccattttctccaacctacaatccaggttggagaaatcatcccaattttgcttggaaccaaggaaattctcatggaaaccaaaactttattcccgcgtcaaaccaacaattccctaggggaaacactgtcccattcaacgcaccgaacaatttttctaacccaccttttccaaaccaacatcctcatcctcaccagcctacaaatcaatcaaattccgatcatgacaaacgtttgagtgtcttagaaaagggtttagaagctatgatcaaagcttctacacaaactaccaacatgttgacccaactatgatcaaagcttctacacaaaccaccaacatgttgactcaatcatccaccactctaaattccttcatgcaaactaccggccaagtgctcaactcgaacactcaagccatagcccggttagaaacccaacttgggcaattagccgctgccgtgagtgagagagaaaaaggaaaattcccaagtcaacctgttgcaaaccctaaagaaaccggatccagttccaataatccagctccactgaatgcaattcacactctgagatcaggaaaacaaatagacaatcaggttagaatgccaccggatcaaaccccttctcccattcaaaacactccttccgacgaaacaattccttccgatgaccaaaatgctgaacttgagattgagcctgatctagataggtataggcccgttgccccctttccagatagactcaaacctaggaaaaactccccgcaggttgagaaaatcctagaaacattcaaacaggtcaagatcaacatccctctcctagatgcaatcgaacaaattccctcttatgcaaagttcttgaaggacttatgcactaagaaaagaaccaccaatgtccccaagaaagtcttcttagctgccaacctcagtgaaatcttttcgaaaccaatgccgttaaaatataaggaacctggttgtcccacaattccatgcgtcataggtaacactcacattgataaggcacttctagacttgggagccagtgtcaacctccttccttattcagtctatcaacagctaggtgtaggagaacttaaaccgacaagatgcactctacagttagctgatagatctgtaaaaattcccaaaggagaggtagaggatgttctgatcaaagttggagagttcattttccctgttgattttattgtcttggaaacgcagcccgtttccaatctcaaaagtcaaatccccgtcattctaggaagaccgttcttagccacctcaaatgctttgataaactgtagaaccggtcagatgaaactatcttttgggaatatgactgttgacctcaatatcttcaacttagggagacagcctagtgatccatctgatgaacccatggaagtgaatttcattcaaggaatatccagtgaacaacaagagggagagtgtgagtctgattcaaatgcatctgatttaatgattgaggagctttctgatgacgaactagagatagaaccactgatcaatcatgtttttgctgttggctagcaatgagaacctttggagatagaaccccgagtccagcttcgcccatctgtggaggaaccccctaagttagagctcaaacctctacccgaaaatctagagtatgcctacttaggggagaacgagtctttaccagttatcatttcttctgagttgactaccggtcaaaaggaagctctcttagctgttttaagagagaatagggaagccattggatggaccatggctgatatcaaagggattagtccaaccattgttcaacaccgaatccatttgatagatgatgccaaacctactagagatgctcaacgtaggttaaacccagtgatgaaagaagcagttaggaaagatattctgaaatgtctcgatcatgggatcatttatcccatttctgatagttcatgggtgagtccagtccaagttgttccaaagaaatctgggatcaccgtgatccaaaatgaggctaatgagctgattcccactcgaatccaaaccggatggcgagtttgcattgactaccgaaagctcaacttagccactcagaaagatcacttcccccttcctttcattgaccaaatgttaaagcgtttagcaggacacgagttctactgtttcctggatggatattcaggttacaatcaaatccctatcgctccagaagatcaggagaaaaccaccttcacttgcccgtatggaacattcgcataccgacgcatgccttttggcctgtgcaatgcaccggccacattccaacgttgcatgatcagtattttttccgacatggtagagcgatttctcgaaattttcatggatgacttttccatttttggtgacacattttcccaatgtttgcatcatcttaaactggtcctagaacggtgtagggagaaaaatctgactctcaattgggagaaatgtcatttcatggtcaaacaaggcattgtcttaggacatgtagtttccaataggggaatcgaagtggacaaagctaaggtagatctcatttccaatctccctcctcccaaaactgtcaaagatgtcagatcgtttcttggtcatgctggtttttaccgacgtttcatcaaggatttcagcaaaattgctagacccttgaccaatcttttagccaaggatacatcatttgtcttctcccccgactgcctcaaagctttcgaatatctgaaaaaggagctaaccacagctcctatcattcatgcaccagactggaccttaccatttgaactgatgtgtgatgcatctgattctgcaatcggtgctgttttaggacaacggtttgatggaaaaccgcatgtgatctactacgccagtaggactctgaatgatgcccagcaaaactactctgtcacagagaaagagtttttagctgtagtctttgccttagaaaaattcaggtcctacctcatcggttccttaaccaaagttttcacagatcatgccgcactaaagtatcttttgaccaaaaaggatgctaaagcacggctcattagatggattctccttcttcaagagtttgacattcaaattcttgacagaaggggaacagagaaccccgtagcagatcacctctctcgactcccaaatgcaccaacatcaaccgttccaatcaatgaacattttccagatgaacaactcctagaaatccaatctgttccctggttcgccgacattgtgaactacatagtcatgaaccagatcccttctcattggtccaaacaggatagatcccgttttctctcccaagtaaaatacttttactgggatgatccatatctgttcaaatactgtcctgatcagatctttaggaggtgtgttcccactgaagaaactaggagtgttatatccttttgtcatgagcaagcatgtgggggccactttggcccaagaaaaacaatttctgtaaccgttctttcgaggctttgatgaggaaatattcaatcacacacaaattgtcaactccttatcacccccaaaccagtggacaagtagaggtcacaaacaggcagatcaaacaaatcttagaaaaaacagttaatcataacagaaaagattggtctgtaaaattgtgtgatgctctgtgggcatatagaacagcttttaaggccaatttggggatgtcaccatacagattaatattcgggaaagcctgtcacctaccagtggagttggagcatcgagcaatgtgggcgattaaacagttaaattttgactcagactcggcagggaagaacagattgctccaaataaatgagttggaagaaattagaaatgatgcatacataaactcaaaaatttacaaagagaacaaaaatttttcatgacaaatcaattttgcgaaaaaatttctctccaggacagaaagttttattgtacaattcgaaattgcatcttttttcgggaaaattaagatcaagatggactggtccattttttgttaaacaagtttttccacatggagctgtcgagatagaaaaccctaaaaatggtaatatttttaaaataaatggtcaacgtctaaaaccatttttagaattttctacgctcggagaggaagaggtgttggttcttcatgaacctcattatctataataataataataataataataaaacaaacaaaaaaaaatttgaataagtaacataaaaaacaaccgaacaactgtaagttcttcaattttatctgctttactttgtgcttcagcgaatttgcattgaggacaatgcaaaatttaggtgtgggggtgagaaatacatattttcctctttattttacctttttagttgcatttttctttctttttgttaaaaaaaaaaatatataaaaatattgtcacttgccaaattaatcaaccgaacaactgtaagttcttcaattttatctgctttactttgtgcttcagcgaatttgcattgaggacaatgcaaaatttaggtgtgggggtgagaaatacatattttcctctttattttacctttttagttgcatttttctttctttttgttaaaaaaaaaaatatataaaaatattgtcacttgccaaattaatagagttaagtaataattgatcaaattgatagattttaaattttctaattcttagttagtgacatattcaagttcaccttttatgataactccaaataaaattcttaagaaatgatttttcaactagtatactttacttaagtcttaccttagatttttaattaaaaacaatgaaatttttgcatgcttaacttagagttgaaaatatttttttcaagttatcttgatttacacaattttttaaagactatatatacttatacatatatattaaaaaaaaactaaccttataaaagaagagtgcgaaaaatgggcaccaccaaaaaaaaaaaaacctcttaaattcaaggtgattctatcttataaagcctaagttgactgagcaattaagcccaaggagtatctctatacttaatgacctaagcccaattgggttgggattcattggcccaaaactcgttaaatggtcacttagaaagcccgttaaaatagaaaacaatcaccaagaattagagagtagaaaaaatatacatatatataacactaacaattgtttttatatattgttgttttgtatatatggtcttgaaaaataatttttgatcaagagacttgaaagttatttaaaacaaagagttggcatgttcttttcaaaactttttaattaaatttctaagatttgacttggttttgtattgctataatgaaaaagattttctaggggatttacattggagttatatataaaaacgttttcttgattattaactagcttcaattagaatgtttaaatatatcaaggaaaatctgttatttactgacttatttaacttggcaagttgaccgaattttgtgggtatattcactgcaaaccctcacgagactacaactcgtccactagggtaacctaggggtttaaaggcttgttgtatacgctaaatacaaccgcgattcctgcgaaagtgagttaggattttctttttattctctttgctagaggactagcaaaagtttaggtatgggggtatttgataatcacattttgttacaattttataccctcattatctattttatatgaataaatataccattaataattattgttagattagtttgcacataattgaatgaaaatataaataaatattattaaatataaaaacccctcaaaaatctctcttctctattttatagcatttttgaagcccaaagaccatcaagaaaaataattacaccaagagttgaaatggacgtggatgcaaagagtggaatgatttggacttggttgctaaaaaataaataaataagagttgaaatggacgtggatgcaaagagtggaatgatttggacttggttgctaaaaaataaataaattggacttttatgcaaagctggaccggacttctgctgctcttcaaaatcaaatggaaatttccattggggccgaactggtgtttgaatgaaaacaaagccatcaacaaatgagcttcatgggccgttgctacaagtttaattctcttgtattttgaaaagcaaatgggaactatattgggccggaattgattttgaagaccggacatatgtttacttgctgcagagttaaaaaaaatcacatgggccaaagaaaaatcaattgaattcacacacatcatggccggactattttgctgcaaatttggattggaccaactcttcaatttcggttttttttgtgaaaatcaaatgggaactcaattgggccggctgctgcataaatgagaaccgaacttgtagaccagacttgtggttttcattttggaaaatcaacaaataaattgggccgaaaattgattgttgattttcttttgaaaaaatcatatgggttaaagaagaaccaaaaagcaaattcaaaggtggagattgtggcttggggctcaagacaaatccaagggctcatattcattgaagattactataaataggggtagagagtgaggggttagagagtgaaaattttgtaaactccttttggagaggagggctactcttaattgagaaggccttccaaaaattgtaactttagttgcaattaataaaaataattttttcctctttaaatttgtactttctcctcttgttgaatgatgaggatggagatgaagagcaatttgaaggtttgcatttcttttctcttttatttctttttagtaatttctttattattgcttattagttagatttaaattcatgcttgtagtatagaattactttcttgtcttttttattttctttttgcactttaatttgtagagtagatttatttttcttgcatttaatttctgcaatttattttgtagtttagatttttattttctttgtaattagatttatttcttgttcatagtttagatttttcttttctttttaattttgtaattagtcttctttttcttgtttttatttcttaagatgtgaatttaattcttgtaggaatcttagaattgtatgaaactagtctaatttcttttatattgtatgaattattctcttgtacttaaaatgttcatgttaggataatcaactagagaactaatcggtagaagaagaatttgataatctatgcttatcttaaatggtttgataggttatgcttatgaattctaggattattatcatgttgttgttcttatcatgaatagtaatttcttattctttattcctaattgtcacgcataaaatataagaaccaagtttaataatctcttaaaatcaccttcttcgtgggatcgatatctttttatactataacttgataaattgtgcacttgtaatttttggtacataattatgcaccatcaagtttttaaaatcaccttctctcctcttgggacgatccccgactctcgccacacacttctcttggtgtacaagtgtattataaagtgaatctcacaataagcacaatacaaagtgtttgttctctacaatggatgagaacgaattataagctcactctctaagttacacaatttcacaacctaattatactatgaatataaatacaataagctcaatggttgtgtgtgtgtaaacaaagagaaaataaaatcaactaaattcaatatgaacactagcttaataaaataataatcaaacaatataaaatataaagctagattgagtttagaaaacttctcaatatatcaagagtggcttctgagtgatacgagtcaccgtgcgagcactcttgatcgcggaattatcaagagtgggtagagaagaaaacgacagaagaacacaagagtataattagggcgaaggaaaataccttctctagattatgagaatcaattggatttacaaaatttctctctcacaatctatctagatcaaagaacaacatccctgatctcttttctgattacaatctgagtgataaaccctagaaaagtcatgtttctatttatactaaacagaaatcctaaacggtgcaggaaaacaggcccaggcccataaccgctacgcggtcgaccgctgagaccaagtcggtcgaacggccagaacatcgttttctagaaaaatcaattacagtgtttcagatcgaccgtagcgcctccatcggtcgaccgctctcagtctcgagacacagtctaggtctgtgcactacgcggtcgaccgctgtgaccaagtcggtcgaccggccagagcccagttgtatttcctgcagtttgacgaatccttcgacttcgccacctccaatgacctcgtccacgactcctttactctattctcaagataccatgagaatcatctatcctcaagctcccatgaggatcgctaagctcccgaaaagaagatacacccatatcggtccctcctttaggaacttgaagtcccattcaagttagaacttcagctgagggaacttgcgagcccctccttctctgttgaaccacttagccttgctaggaacctgaccttgacgttcaatgagaaacgactccttcgtcccccgtctcatcgtggttgccttccgttccaaaatgcaatcttctttcagtggctcctctctatcaaaccacaagtcttcaacatgcggtaagatcatcttgtcatcaccttcatcatccaataatggaggctcaaacaacttcaagtactcgacattgatcaccgaatacatgcctaagtaaggcggcaaatctaatcgaaaagcgttgtcgccaatctgatcgagaatccgaaacggaccataacgaataggcttcaacttcttcccttctccttttagcctctccttactcagttttaaccataccatatcgcctttaccaaagttacaaggaacccgatgttgatcatgcttcgccttgtacttagcttgtgatttcttcaattgagcttcaaccgtggcatgaatatgtgcaatcttctcgagaaatcgctgagcacattgtctttcactcccctctttgtcgtccaccgtggcttcacacgaaaacacaagatcgaacgggctcggcggtaaaaatccataacaagtctcaaatggtgacttttcggaagatccatgaatcgcccgattaaaagcaaactgtaaatatggtaaactctcatcccaagtcttaggatgcctggaattatagccccgtaacatttgcaccatagtccggttgactacctccgtttgtccgtctgtttgtggatgaaaggccgtgctcttcttcaatttagtgtccatcaaactccacaaagaatcctaaaaatgcccaagaaaacggctattccgatccgaaataatcgaactcggcaacccaaagtgcttccacacatgctcaaagaataattgtgctacacccgctcccgtcacggtcttcttacaaggaatcaatatcaccatcttgctaaaccggtccaccacaacgtataaatagtcatgcccgctgtaggcatataaaattgcttataggtcccttagcacagctcggcacaaaccgacgaaccaacga

SEQ ID NO: 139 - DNA, 120750 bp, Asparagus officinalis
  misc_feature (3304)..(3474): n is a, c, g, or t
  misc_feature (10952)..(10967): n is a, c, g, or t
  misc_feature (25964)..(26004): n is a, c, g, or t
  misc_feature (63825)..(64785): n is a, c, g, or t
  misc_feature (73798)..(74012): n is a, c, g, or t
  misc_feature (98782)..(98791): n is a, c, g, or t
  misc_feature (100212)..(100240): n is a, c, g, or t
  misc_feature (103163)..(103751): n is a, c, g, or t
  misc_feature (116298)..(117283): n is a, c, g, or t
gaaagagagagaaggaagagagagagaaatgagctgggtacgaaatgagagaggggctgggtttaaatagataaaaaaaatgaataaaataataaaaataaaatattgagtgagatacgcgtgcagcagtcatttttgaaaaaatgcggagggagagaacggggttgttggggtttgtcacgggagcaaaataatgttgaagtattttcaaatagtttcaggtatttaaacgaaaaataattaaaataaataatttcgggtacttaaaaattaaactaattacataataattatctataaataaaaacgtacattttgagctaatacaacagttgatatgaaactgtcaaaaatatacccgtattgtacaattaaacggaaataattaataataaaaatatttacttacatttaaaatcaaataattatgtgacaattatctacacgataaaacgtaccagttatgctaatacgacagctgatacgtaataatacaataatttacacaaataatacgtaattaataattcaatataatacaagaattaatacgtaatagtaataataatacgacgtattatttaaaataatacgtaatagtatcagtaatacaacagataaatcccataattttttattgcactaaattaatttataaatataaaaaccatttaaataaatataaaacttagactttaaatcatagaaaattctagaaaatcgagaaaaatacaaatactcttttaaaaatcataattaaatattttaaaataccaaaaatttattttaactagtatcaaaattttacggtcattacattgctcctccctgacgaaacccgagtcaataagctttttgacttcggactcgattgcctccatgatttgtggacgaaatcgtctttgttgttgtttgacgggtttgacatccggtttaatattgagacaatgcactactacatttggatcgagacctggcatatcttcataattccaagcgaacacatcgatgtattccctaatgagagagattagttcttctttctcatttggtgggaggttgtcgctaatgaatattggcttcggattttcctcgcttcccatattcacttggaccacttgatcctcggtaggaggttctctttgttcaaacctatcaccgtattgcatattcaagtgatgaacccaaaggtcctcccaagttggcatttgatcgtcttcctctattgtagcaggatcaaccgtagtcttgttcaccattagccttttaaacatttctccgagactggcgtcggagtcccaggctgaagagtcggaagaatatccatttttgcccttattagcgatctggtcgatgacctgccagcaacattcgtcatcggacgaggagacataacctaaaccccttctgtggcgataataatcatcaggttttccttttgatacataggccattcggggcggaactcgcggacctcgaccaaagcaaagaccttctcctagcgtgaaatcatatccatacttctccatgagatcgcgcgctttcgtgttatacctaaatagatgaggggcaggtttatcatcattgtcttcctcttccaagaagtggtcgggtatcggagattctcttcctttaccgtagacgacttccttttcacctcttgtacctgctttttcgtcatgcaaaatgattaaagtggcatatacaagtcagggttatcatataattctttagtgatattatcaagacacatcgagtactctaaatcatcgtttattgatagttcttcggcaagtttccagttacaactactttccgatgattcttcatcatcaagattgattataatgggtacaatgtcattaagtacaaaaccaccatcataatcgaacctagcttcggtatcagcttcgtccccgctgtccgttccttgggccgatggttcagtgtcggattcggcaccgtatagaagggagtcggtaaaatagttctccaatcccttaaacggttgcttatccgcgaccaccgtcttgacttcgttattggtgtccacatatttgaggcactgatgaagagttgacaggactataagattaccgtggatccaggatcgacccaacagtaagttataggatgtttccgcgtcaatcacgtagaatgtaacttctgacttcaaatcccctatctggcacttcactcgaatttttcctagtggtctggacccactggtattgaatccgtagatcgtagtgtctgtggaggctaacttactagccggtattccgagattgtacatcaatcgaagtggcatgatgctgacagcggaacccggatcgacttggatccggttaacaacgctggagccgatgtgaccggtaaaatacaagggtcgatcatgctttgaattctttatctgtatgtcttcttttgtgaaggaaatacaaggaaaacggtgtgccgcgaggttacaatgttggactggcggctccggttcttcggatgacggcttgacctgagtcagaaaaacttcagaattagccaaggctttttgtaatgcttccctgatatctttcgatagacgtaatagctcatatagagttattctagcaggtatattggctaactgcgtcataatatcgaaatgaggtggagcgcttgaacttcccggtttgtctctcccaatcggtagattgaatcgagactgcttcgggttctgaccctcttggtataagagttctttccctttttgcttttgttgggttttctctgcaactgcgggtgttggaggagttgcgacaattcccatctctgctaatgtcttagagggaacggttttggttaccccctgtttagctaactgttcggaagcatccggatacttgaagtgatactcatttccactccgggtcacgaagacttcttgttcatcttcgaaaagcgggaaagctgggattctttcgtcatcttctcctggaatagcagaggctccatagcaggactttccttttccttttgactttctcttggaagaggatccggtccactgttcatcttcaatcaagtcggggtgaacccagagaacttcgccattcggggccgtgtgtggcacaagtcccttctgacgttgtttataaggatcatcgttcacggtgttcattgcaactttcatcacaggttcgggctgaaaccagttcaacgggacagatccgaagctaatcgacactgcattcgcacccactttcttctctttaggctgcttcatagtgatgactcctacatcaatcaaagcttggatcttatcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaatttcggttccgaagccttctgtttctgaggctgttgttgccatcgtgactgctgaggcgccttctgctgctgttgctgcggttgcgcttccacttcgaatgtttggttcgcatccactgcattcacttgcgctttccctttacccttaggaacaaaattctgttgcggggctggtgccgccgtttgacctctttcggcctttttcctcttgaggaaatgttcggctctttcccctcggaccttcaaatctttccaggtcttagacggtgccattcccatggcttcgagaatatccaatgaaaggttgttatgacaagtctccaggttgaaatcctcactgatcggatccctacaattcatggttttgttccagaatcgtttaatgaaattctccaccaactctccgtccttttgcttctcatcaaataatgttccgatcgagacctcagtgtcgttgtcgaagaaatttgtgagaaacatgtcctccatgtcatcccaactactaatgctccccggtttgaggcggcgataccaatcgaaggctgctccgcggagagtgccgacgaatgaccgtaccatcaaaggttcattcccggagattatccctaagtgagacttgaagtatattaagtgctgagtgggggagtactttccatcgaacggtgtgaagttgattaagttaaacttcgccggatacgggattaactcccactctcttggatatgggcacggtattccggaccttttcacttcctgagcattcatcaacgcattgattttgctctccaaatctctcattttcttatcctcactcgtatctgtcttcgagtgatttcggggagaagtaacgtggtcctcattcgtattgttatcatccgagggaccatccccattattgttgttgacgggaggggtgttcatgttggcattatcctcttctcgctcgttatcatcttggttcggattattgcgacggctagactctccttgatgagttatcaatgccgcgatttgctggtcatgcatctccctcattcgctgcatagccatttccatttcatatttaaaactgtctttttgcttggttaaagcgtcctcaagaatcttagtcacttgctcggcgctaatcatgagtgattcgtagggttgtcctgcacttgatgtggtgtcatcggaagccatcactgagcaagcatccgagaaagcatccgaggtttcatcatccgaaggcagtcccttctgcattctttggtaatcccttcgtctactggtccccgatcgcaatcgagttatacgctgggatactgcggcaaactgatccggactaaagtgtcgccttgactttcctctcccggtcatgttaacagatacttttggaaattcatcatcatggagagcagctctcttctttcggaaacgtcttggtctggattcggacattttggtagagattctttcaaacactgaaactctctccggggtggtcttggaatagcaacattctgacaacactgccttgatgattttggcacatggacagtgagaacctgtgtcccgggcactcattttcctggatttgttcgcacccccagcttgatagtacaactcgtcagtttgatgactggagcaacctatcgtgtgttggcacgacttcccaggtataacgtcttcgtctgacgagtacgttttcttctggggatacaacgcttcgttagcattttcaggagtcgcatgtctgaggtgacgtttttgtgaatgtcggccctcaacaggctcctgaatttcaacacgcagtccaatgcggtcatttgcgggacttttcccgttatacattctcctccactgcttaggatgacgacctccagcctgacaatgtgctcgagattcattcaatcggcctaagtgctctttgaccggagctttgcctcgatcatcgggtgagggaacaaggcgatctttgatggtcatcttaaaatgagacaaatccacactgtcacaaatctcaaccggaggtgcgaaactcgatggaattgaagaaataggtgcaggacatcttctgccttgaatctgttgcgggtcagacttgggtgacccgcaagttggaaggtcggatttggacgacccgcagactggaaggtcggattgaagtgacccgcgttttggcgggtcggattggagtgacccgtgttttggcgggtcggattggagtgacctgcgtttcggcgggtcggattgaagtgacccgcgctttggcgggtcggattgaagtgggtcggattgaagtgacctgcaaattggcaggtcggattggagtgacccgcgttttttgatctttttggccgccgtcttagactttggcctccatacttggtgcagtctttgtggcttattttccactctttctttctccaatttcttagcttcttgcataagaatttttgcttgtgcaaacaatacgcggcgtttctgaatccgctcttgaagagtcgatcgggtccttttgacgcgaacccatttgttcttcgctggtttgaaagaggaggggctgcccactctctgttgtggtggttggcgcctcctagatttcagatccgcttcataacagattccatcaaccggttccaaggctttagccagttggcgggcgaggcgttggcgtcgcctctgacgtgctctctttgatagagtgggcacatcatcaacagttgaccccttactcaaggggttcagatttgtagttttagcctcgtcggatgccggcgaggcgttgtgagccacgggtgcagcggtggcgggaagatcttcttgggcttccgcagctgaagtccaacgggtcttcctggagtaggccttcctgcctctgcgaggagaggccgatctggaggaggaggacaagtattcctcgtacttctgctggtcgaactcatattcggcctccgtttcaaccgggatcgggatccgaggttgcgatacgtcagccttcgcagaaaggctgtcggctcccactgtggtcgccagtttgtttccgtcgaaagttaccttagtcattgattttattaaactttaaacgttacaaatgaattcaaataacaaaagaataaaagattacaactttcttgaaaataaacacaagatccgtttatcggctcttgcttgcgtgggttctttgccggtgtcggggttaatcggtggacgaccgcgaatcagatccggttgtaggaaaattcggcagagcttcgccttagccgaggaagttttctggtttgaagcgttgagatcgacaaagcaaaatcagggctcttcttgagattaagaccaagcctaatctcaaggaacggacgtacgggcttcgaatccttcgaacggcttctcctttgctccgaagttcgccgggatctcgttgaccttcgctgaaattccgtgctccttcactcttcaatccagcagcacctcgtcctcttgataaaattccagccctcgaaaatggaggcctttggctcgtatttatagcccccggatacggttattttggatcaaaacaagtgatttggctctatcttcagttaacaacagcctaaccacgtttggggatgatatcaagtcagttaggaacccctgaaacagataagtcctgcgaaaacagcattaaaaaccgtcaaaacgcatttcaggatcagaactgcgcggcgcaggtcggacagatccgacccgcgcttgcgcgggtcggaccaatctgtgcgggtcggattgttccgtcccgtacttgcgcgggtcggcttgttccgtcctgcgctcgcgcaggtttgccgatttttccttcttttccgttctctttcttccgggacttgtcctttcgcgtgtttggttcgctttgttgacttgtatgctttgccgcaagaccgattgtcgaacacgcgttggttaatatacgcgtattgatcgatgcgcgcggactgattggcgtgcgcgcgttgaccgacgcgtacgagctggttgacgcgtacgcgtttgaccgacgcgcacgagatgatttgtcgtgcgcgcgctgaccgacgtgcacgagatgatttgacgtacgcgcgttgaccggcgcgtacgagctgcttaggtgagccttcttgactcgccaattcattgctttgagtttcgtgcgggctctcataggcaattttagacgcctacattcataagttaagaatttaatcgtatttctagttgtgtgactgtgcaggaaatttgtaaaatgctgagagtcacccatgagggaacgtctcaggtaaagaaggccaaacttactatgttagtaagcaagtacgaaacttctagatgaagacactagaggctcttcaagatatgttcattagattcaccgatatcgcgaacaaaatgaaagcacttggaaaagagtacccacaaggatgaacttattcgcaagtgtagcaaccctattcacagtttctgttgtagttatccttttgtgattgtttatcttgtttaatttttttttcctttatatttgctacattttttgttaacttaacgacaaaatttttaatttgttgaaaaagtgtagcaaccctattaatccccctctaggattgcatctagatcctaacatactcttcctattagaactgcacgtatgcatgcagacggttctgatagtatgagtactcctactaaacccacttttagcttgagaaattaattcattggttaattaacttgacgaggccttcagcctcctaactttcaatattatttttttaaagaaaaagaaaagtcctacttttgatactttttaaaagaaaagggttaattttagacctcctcaactatggggcttgtcttagaaaactcttctcagctattttatatttagaaaaactccctcaaatttgaggatgttgtagataactcatcttaacttttaaaatatgactaaacccctaaactatggggtgtcttacaaaatcaccttgatctttctagttttttcaaataaccctcctaatattattaatttaaaatatgtaatgactaaaatacccttggttgaaaaaaaatcatgtgagttaaaaaacccaacccaatcaaaatactagactttagttcaattggttttgatgaggaaactcatcttcaaaaaaagtaaaagttttaattatttcaagcattacaagcatgaataagcaaaaaatagaagaagtttagtgtttcaaaaaagaaagaaaaaattaaatttgcacgtgaacctaaaaatagagatggaggaataagaagaggggagatatagaatgaaagttatttttaattaaaaaaagataaaaaggaacactatggcaaaaaaatgtcttagggatagtatgattgttttaaatcatttatcccattagattttaattatattagtttaggaggttaagtgagaaaagttgagtggggatagatcatattctgaaagctaagtggggttatctacaacaattccataattgaggggggtttctagagttaaaatagttgaaaagggtttttccaagacgacccccgtatttgaggagggttttctaagattaattaaccccaaagaaaatctcaaagttcgactttattttccaagaacacacatgaactttggataaaatttcaaaagtccataaatcatcaggggtaagctgaaaaattacaagcatctggaatttggtgatgagcccaaaaactgatgaatagctgaaatttggtgataagcatctattttcccaatgccacccaatccatattctgactccgacattaaatgcaagaagaaaccagagaaactgatgaatagctgaaatttacagcatctgcacactggtactttaaaaaaaaacaacacaacagatgtcggagatttcatactaattgaaggacaaaatactaccgtatcttctcacttgagtttgaaatcaacatagggtataaatatgagatgggcaaaattgcatggagaagccttggtgtgatcaaagtattgtgcgctcgtgagtgtcctttgcacttgatgacaagccaaagagcccgtgaccctaagcaaaatgcatgctctgtactgatctctttcgcttcatctttgatcttttctttggactctagctccttacaatcaaagctcgtgtgaactacacttcaataaactctcctttgccgcaattttaataaattcgttttgggtttttccgtgtattgaactacacttcaatacacggatcctatatatggcctttcgcctagctttctcatgtttttagctcgttgaatatgttcacgggcatacaagttcaaatcgatcaacgcttgaatctacgcaagtgaacagttctcccactacatttttagtttggggtgtagtgattgtaggtaacaaccatagtcattatagatagattggggatctgagtgataccccatcctttgtcctcacaaaaaaaaaaatccgacttatacttaaatctatacaattcacctagctttcaacgtttcttaatctttttacagaggacaaattttcaaaaccgtcctatatggacatttaatcccaaaaacagagcattttccataatattttcaaaaatcgacctggtttcagccttggcgctgaaaccaggttggtttttgtgaaaaaacttccgaaacttcacaggagttgaactcccgtgaagtttagtaaagctgctaaacttcacaggagttcgtgaggtttcatagttcaaaaaagttttttaaactatgaaacttcacgagacttgaactcctgtgaagtttagtagctttactaaacttcacgggagttcaactcccgtgaagtctcaggaatttttttacaaaaaccgacctggtttcagcgccaacgctgaaaccaggtcagtttttaaaaatattataaaaaggggtctgtttttgggattaaatgtggaaagagattgtttttgaaaatttgtcgttttatagatgatttaggttacctgaattacacatgatatctcgttaagttacaagaggaaatttcacataacccctgtttgtggaaaatttgtagtaaaaagacaatgaaggaaaattgatctgtattcttttaatctcaattacaattggatttcctgattacaaaagagaagagaatgatctggattctcccctttgtttaattctgggttcttcacggtggcgatgagatgcctccctcgaatgctcgcgtcgagtttgcttctcgttgacgatccgacatcttgtttcactggaacatgatcttctcctcacgatttgacgttgtggataactctgaacgagtttgaaactctatgaaagagttgatttgaaccgagaatcggttctcaagccaaggatgaagaagctcttgttgtagatctcccaagctccagaaatgctctaaggatcctgttgacgagccaagaagttctaaccgaccgnnnnnnnnnnnnnnnnttgaacgcagcatctggaagtgcgttctgcagcgatatggagctgcgttcttcgatgtttgaaggtgcgtttcgcagtgttatggaactgcgtctggcggtgattaaagctgcgtctggcagcggtatagagccgcgttgggcatcgattggagctgcgttgggcagtggtatagagctgcattgggcagcgattggagctgcgttgggcagcggtatagagctgcgttgggcagcggtatagagctgcgttgggcagcgattggagctgcgttgggcagcggtatagagctgcgttgggtagcgattggagctgcgttggacagcgattggagctgcgtttgagctgcgttcgtggctatgaacgtggcgcatcttgatgctggtacgcggggaggacttccacgtcttgatttgaagagaccatcgatttgtagtctctttctgtcagagcgttgcaaagatcgtcgttttgtaatctttgctttagctctttgatatgtgagagtcgtcagattataactctcgatgttgattgtgaaggctgttgattagagctttcatcagttgttgcgaaggtcgtcagattgtaaccttcatcgatccacgtgaaagtcttcaaattgtagccttctgaaagtcgtcagattgtaacttccatcatcggtgtttgatggggatcagctatctattgtgatttttagacagcctacaaccccctatcttgggaagttacatgaatgacgggattattacaatgtcgcttaacctccctaacttttaagtgggtcaccaaacaccccaaaggtttgcaagttcaacatatacctcataactttcgacgttattctgaggaaaaaacccaaaccttcaacatcgatcattttcagaaaagccaaaacttcaacactatttcacaaagctctcatgagtgttaaaatatagtttcagaaaaaccccattatgctgttggtgggggggtatagtgaaaaaactgtaaacatttgatggttttgtcataaccaaaaagttacatggattgagtgacattttcaaagtttgggggttaatccgacaacagtccaaaagattggggggttatgtgaaatttaagtagagggcattaaaggtgtttgcgtcgaaagttgttttcattactgaatccattacacgtttatcaattacagattcaaagtaaaattagtctttttataagactttcttacacaataaaaataaaaaaaatacaactctcttcaaacacacgcagataacgtttatcatatgctgcttgcgtgagatctttgcttgtgctgaggtttatccgtggaccaccgcggatcagatctggttgatcggaataaaagatcaatgctcttgcttcacaaaggaaacaatcgcagaagtaaataatcttgaccaagcgagattacgactattctcgagatcaaaaccaagtttgatccggaggaaaggggaatgagcatcagatctctcgaactttccctttttattctgaagaacttcgtcaagatctgctagcctctatgaaattcgtcagaacctcgtcctagctcttctaaaattcgtggctcccttcagatctacctttatgagtgtactaggagtgtatttatagattttaaatatcgtatttgtggataggatcgaagaacaaccgttattatccgtttatgtgggttttcggttgtgtaacagctcccacacgtttaaggataacctcacatgtttatggatgaccccaaagagttctagaaaccaatcttatcagaaaacatgttgggagctgacctgggcgcgagtcacttcgaagtgattcggaatttccgagtcactttgaggtgactcggattctccgagatagtttatactgtctcgggtattttggttttaattctctcgtccgatcttggaatgaagtgattcaagatgcgttggaaatctgacgaatagagctacaacttttgtctgttaagatttttcggattcaaatatcatcatggttaaaatttcaattcttcgtacgggtcactctagagtgacccgcacatgtgcaagccaccttaagccctcctgattatatttgcttcgtcatttcatacgtttcgacgtttcacgtgcgttccttcgcttctttttacagcattggatgatcctctttgacttggataatcctctctagctcggataatagagttcatcgcattctctccttttcgaactacctgcgggaacctatagataatttttaatgcctataaaagggtatgaaaactttctaacatcatcatcttcttcttcttatttattattataaatatttgtttaatggaactcgcatctatttctatcatgtagtacctagtctatatgtagctaaacaatacttctgtgataggattcattcaacttaattgcaaatatttttgagctagaggtagcctaaataattctcctgcaaaatctacttgatttcatccaaatccaagatacctacggatatagtaagaagtacaaattttcatgcatagtccatgttaactgttctgtgatacttttatgacaaacactagacgcctatttcccttcatcctgtacccattttgtttcagaatccccaattcataagaggcagttttccttataattttcaactatatgtcaatctgcagtagaacaagcttttaactttagacaccagaaaaataatgaatgagaagcatttaacttatcatttacaaacaaacttaggtatcgctttcctccccattgccacaaaatatacaatggtagcatctggtgccgttgaagtatcaactatagtgttgtttgacatcaaacatgcgtcaatgcgtagcaactaatgaatgttaagttcataacatccttaagtcatatttcaatggtagcgctaacttatatcgtctcttaaagagttactgacaattaaagaagatctgcagtgtaacactcaaagcgtatatttacaatttggattaccaggggcttctcaaaagaagaagaaaaattgactaccttggactatacttcacaaactactgagatgtggcttatttcatggttccatccgtgtgcaacaaactttggtcgtgcagtgcataatacatgataagttatacataaatgaatacagaaatgaatagagaaatgaatacagaaatggactggcctcaatatcctctactaacaggcaatacaaaagtaacctccaagatcatataaaattatcttgattcctttagcattttttatcatcgaaagcaatacggacattctcttgaattcctgggaaacagggttaattgttcactttcttttcagctctctatttctatgagcacgcaactcttcgctatctttcaagataattggaagatgttggatgtgacaacgggcaaacattcaagaagaatgcagttcacttacaacttcattaaaagacccaacactaatgtccagaaaatctgtatcaaaatgccccctatcgaattccccgaatgtgtgctcagatcaatagaattgtctgcttgtgtatgagctttccccacaagatcacagtacctccccaaatacagctgaattagaatacccataggaactttatttaaaaccattaaaatgttgttatatcctttgagatgagactgtcaaattcaatataatgggcaaggtaatgctagtgctttgaaattattgtccctccttaaggaaacttaatatgcttctacaagtgcagagcagtcacatatcattttccagttactttcagttctacacgtacccaatttactattcgtcgttgctttctattagatatttttattacacattcttggaacaagggtcatatactgatattaaggcgtaaccttgcactatgccatatacttgtcccaatttgaatataatcacaaatggtatggctgtttctagcaacataaacactaaagttgaaatgaacctagcatattgtgatctgtcaagtctcacctatgattgaaaaacacttcctctattacttctggtatgaatctcctcctgcaagtcgctgacagtagcctgcaaatccaaaaaaaaaaaatcagacgaaacccaaaactgaccctagatctaggagagcaaccgaaagagaggaaacaagctacaaaagagaaaatccaagtcagatctagggtttcgatggaagggggagagagaggagtaagggggagaccgaaaccctagatcagatctagggtttcaacgagagaggagaaggggagagatcgtagagatacctgttgctgcgttgagagagagagattcgagatcgcgagaggaggaggcgggatcggtcggagctgagaaacgagggagaggaggagtcgggatcgtcggagctgagaaacgagagaggagttcgggatcggggtttggtaaatgacaaggggcagggtgggatttcaaatacgggcttttgggctttcaaattctccctttaaaataatttgatttgaaattccagcccagttttgtagcccaaactaaggatttggatttgaaataccttggatttaaaatccagggtccaaatccatgttcccaaacacaatataattctatggaaatcaggtgacatgagttgcatattttgatgattatatgaaaccttggagctgtagaatgtcttagatgatcagatctatatatacctgtcaattaaacggctaatatgcttttcattttgatattgctacttcgttttctagaacactcaaaattgaaagaatttctagagttaagtagcgtgaactgtactttatagaaccctccctctgttgcaagagataagtttgttcgtcctttattgcaatttcagtcgattggataatgacatttcaaggacgatggtgagcaaccaaatatttcggagttaaagattgtttctctagtgattacagtgtagaagaatgagcgtcaaaacattaaaaattgaaatttttattccaacgataatatgttgacttgataattatgtttcgcaagaacagtaaattggaagtagtgtttggatctctaccaagttgaacatgaaattgagacaccacagcttttaagttgttaagacttgtttaatatttgaaacaattaaaggccgtattttttttttttttttgagaaaaaagatgagagatcccctagtgtttcattaaaaagagtttaataaaacatatagatataaaaatggggtttttgtttttaggcccaattgtttactccactttatttttaaacccacctactattatttgtatctttaaacccaattctcttttggtatttgtctttaaacccaatctccaaaatacaatacttttagtacttgtatttatacaaaatcaaggtaaaaaccccaaaatacccctttccccatataaaccactatatctcttcatcttccccttttcaactcagccctaaattaaaagacgaaagctccttgccgccgtcgcccgtctccagccaccgtcgccctctcagagcaccctcctttcgtcagtccacagcgtcatcccaagaggacctgaccccaaacaatgaatctcaacgctctcctcccccaaagtctcatcatgaactctctcctctatccaaaccctaaccatagccctaatttcaccaaaacctctcctttaaaacagtccaacctctcaagctcaaccgattggatctctctcagccctcatactccccgaatcggcctctcgctcaaccggcggggctcgacctcgaggtccgctctctactcagagaggattgatttgactgcaattagattcggatcctccgaatccggcggtgttgacgtcgtatcggagctccgatatcccgagaccgaagcagatagtgttggaggcctaggctagggtttgcacgggaccggagcagacgaagccgatgaccgaggagcaggcaatggcggtccttgagacgattcttagatcaggtgacctcagttcttttaagagctcttactaatttttcttaaattgaggtcaacttagtagttcaacttaattatcttcttatttttttggtaatttctgcttatttatgttcgcaaatgataactgggaactttgagattaggcatcgaaatatgtatataattggagcatagtattagagtgcagatgagattaaaatacaaaaactgtaagtttatttatttatttatttattatttttttgggaactatgtggaacaatttatttgaagtcagagaaagagatattgatggtaatctgaatttgttgcctagagtcattgtggactttacttactggatatagttcacccttgtcccttgtcttcgcagttttggggcattttgtggcatactttaactgtgtgtacactatatttaaactgaaagatgtttgcatattttggaaaaattgttctactagatatttctagctgcaaaatgcatctcttgcattatagaaaattgactgtttgccacttcttacatcctttatttctcaaagaataaatatgatctatcactttcaactgaaaggtaatatccaacaggatgtagtccatgggtaactgtaatcttaactttctttgttttttttagagatgcattaatgaaaataacccatcgagtgtggatcgaatgtttaagccaatgacgacaactcaattccaaaaacttgataagattatttttccactcctaacttcatttcattggcatatgttggtattctttgtaaaggatagaagattttatcattattcttttcttcgcgggtatatgcctgatgcttgtgagtttagagtgaatcttatttctaccattcccgatgcttggaatttagacattacttcttgtcaggaggtaaaaagtgttgatgtacctcaacaacgtgggttagtgtatttgacttattcatatgttgttgtttttcgtatgtgctaacacatagagactatatattgtgggccaagagtgttatattgatattgtaaacatttgaacttgcagtagcttggattgcgggatgttcttgatggcatacatgtttagcctcgtttccggccaaccaatttcaattgaccaaaaggattgtgcaagacatagagctcgtattgttgctctatttcaatctaaaggtatattttctataagtgtaatgttcattgaaccgcttatattcagtctattgttcttttgatccgcttatattttgctttcaggaaatcaacgtgatccccaagactaattccacggatgctagatgctatcaagcattttttgtgtacatatatatgtttggatgatttgtaaagtatttgtataaatatatgttgattatgtagtccatagtgttttgtgtcttttgtggtagattatagccattgtggttaaattactgggttatgtaaagttttgcatgcttctaagtcattgatattgatggttaaatttattttagacaataaccattgtttgcgtgttgtatgtgctggaatggttgaagaaacttcttgatttttttgtgtctcttggatatgcaatgttttcttggatatgcagtgttttgtgtctcctggatatgcaatgttgtatattgtttgcatgttgtattgtttggaaatggattaagtatagcacgttatgtatatagtttgtcaatctcctggatatgcaatgttgtattttcttggatatgcaatgtttggtgtctcttggatatgcaatgttttcttggatatgcagtgttttgtgtctcctggatatgcaatgttttatattgtttgcatgttgtattgtctagaaatggattaagtatagcacgttatattgtaagtatagcacgttaacctgaaaatatagcacgttaatctgaaagtatagcacgttgtattgtaagtatagcacgttatggagtaagtatagcacgttaaattgtaagtataacacgttatattataagtatagcacgttaacatgaaaatatatcacgttaacctgaaagtatagcatgttatggagtaagtatagcacgttaatatgaaagtatatcacgttatattgaaagtatagcacgttatgaagtaagtatagcacactatgaagtaagtatagcacgttatattgtaagtatagcgcgttaacatttaagtatagcacgttaacctgaaagtatagcatgttatggagtaagtatagcacgttatattaaaagtataacacattatgaagtaagtatagcatgttatattgtaagtatagcacgttaacctgtaagtatagcacgttgacctgtaagtatagcacgttaacctgtaagtatagcacgttgacctgtaagtatagcacgttaacatgtaagtatagcacgttaaattgtaatcatagcatgttaaattgtaagtatagcatgttaaattataagtatagcacattatatcgtaagtatagcacgttaacctgtaagtatagcacgttaatctgtaagtatagcacgttaacatgtaagtatagcacgttaaattgtaattatagcacgttaaattgtaagtatagcgcgttaaattgcaagtataacacgttatatcgtaagtatagcatgttaacatgtaagtatagcacgttaaattgtaagtatagcacgttaaattataagtataacacgttatatcgtaagtataacacgttatatcgtaaatatagcacgttaacatgtaagtatagcacgttgacctgtaagtatagcatgttaacctgtaagtatagcacgttaaattataagtatagcacgttatatcgtaagtatagcacgttaacatgcaagtatagcacgttaaattgtaagtatagcatgttaaattgtaagtataacacgttatatcataagtatagcacgttaacctgtaagtatatcttgttaaattgtaagtatagcacgttaattataagtatagcatgttatatcgtaagtatagcatgttaacctgtaagtatagcacgttgacctgtaagtatagcacgttaactgtaaaaccccgtgcattttgatgagttatggtagtgtcaaccagcgcaggagtagcgtcgaacgagtcggcgagcagcagagtcgaagaacctaattttcagctcatgagtcgacccataaatcatcatgagtcgactcatcaggttgagtcgacccatgactgtcatgagtcgactcatgatatcaactcctgttgtcaaaagtctctgctgagtcgactcatcaccttatgagtcgacccatgagtcatgagtcgactcacgactgaacatgagtcgactcatcgagggttttctgggttttttctgtgtcggggttgtttgggtttcgggttgggttttaactgttcatataaattgtaagtatagcacgttaaattataagtataacacgttatatcgtaagtatagcatgttaacatgtaagtatagcacgttaaattgtaagtatagcacgttaaattataagtataacacgttatatcgtaagtatagcacgttaaattgtaagtatagcacgttaaattataagtataacacgttatatcgtaagtatagcacgttaaattgtaagtatagcacgttaaattataagtataacacgttatatcataagtatagcacgttgacctgtaagtatagcatgttgacttgtaagtatagcacgttaaattataagtatagcatgttaaattgtaagtataacacgttatatcgtaagtataacacgttatatcgtaagtatagcacgttgacctgtaagtatagcacattatcctgtaagtatagcatgttatcctgtaagtatagcacgttatcctgtaagtatatcacgttgtactgtaagtatagcacgttaaattgtaagtatagcacgttatcatgtaagtatagcacgttatcatgtaagtatagcacgttacactgtaagtatagcacgttatactgtaagtatagcacgttatgctgtaagtatagcacgttatcgtgtaagtataacatgttatcatataagtatagcacgttatatcgtaagtatagcacgttatcatgtaagtatagcatgttaccatataagtatagcatgttattatgtaaatatagcacgttatcattgtaagtataacacattatccatgtaagtatagcatattattatgtaagtatagcacatagattgcagtccatcgataacctgtcgatcatcaatggttgacttgtgaccatcgatggttaaaggctaaaatctacaactcatgttgatgtttgcattatttcgagtcgtcacttatttgcacccgtttattcctaaaatatatcatctcacaaactcattagtaccaaatgaaagtttgttgttgatcaaacggagacattgtcaaattatcattcaataagtactccagcatttatcaaagcataaaccacagtgtgtgtaaaaatcaatagcctattggattgctcatatatcatccgaacattcatcattcattttttgttaaacatttcctccaaatttcacaactctacccttaaccttacatatttttttcaacaacactgatgagaaccaacaagatgaggaaagttaagtatggccctcgaccctcacatccaaaacatcgcccggtcgtacgccatcgcggcctcttccgccgtctcgaacatcccgagccaaacccaagccccattcttcccgggatctctcatctcggcagcaaacttcccccgtggccgctatctcacccctctatagcgcctctccaccgctgcgggagctgccgcatcagcctacactcagggccggttctgagattttaggggccccgtgcaaaaattaaaccaaataaactcttcagaaattcaaaatgtattaaaattcaatgctaaataactaaattccattaaaatttgagaatttaccagtcatcttatcatcaaccccagcataataggagtcattagaggagtaagagaacccaactcctgctggtgtctccaaatacaacatattaatgaaggctataatgggaatttaagagaaatatttaaggggacccacatatgaaagtatacttgggtgtaaagataaatacaaaaaaagagttgggtttagatatacaagtaatagtaggtgggtttaaaaataaagtggagtaaacaattgggcctaaaaacaaaaacccctataaaaatatatcactcccctgacaaaatatcaaaaacatacaaaaggcacatcgccaaaatactagtgggttcggtggaaaagtgcataagccaaatgagggactctttgctaattagatcctccctcatgatcgcccgttgatacatcatgccatacaacttatcaatcattgtagtaatcatgaacttgatgcacaattcggcatgagctaatcatgcaataactccgtccctcacctcttctaataagcaatacatgatcactgttggatagagaattcctagtctattttggtaacatgaggttattaggattcctaatctattttggtaataggttattaggattcctaatttgatttggttttggtttagaattcctagtatgtttatgattttaggatttctatatatatggaacaattagaagagagaattggtggagaagaaaaattggggatatttggagcacagaaaagaggtattttctgaactatttgtttagggttttgtttggagagattaagagcttgttggtgagattagtttgttccttcgagtgatttgtaatctcagtttgtactctttctctattagtgaaaaccccatccccttctagccccgtggacgtaggcaattgccgaaccacgtaaaactattatgtttggatttgtgccgttgttttgatttgtttggcctttatcttgacgtttgtttgatttggttctcgaagcacgcccgtttggttgtcacgcttccgcggcgcgcacaacaatcacaaactctaccaattgcattagcatcgtttgagaaaactttcgacaatcgtttcgtcacatccaatccttcgatcatagctgaacaaactcttgaaggttgcagaaaataagaaccaggaaatcaagaagtcacaagggagggacccatggacatcgcagctcaagtggctgtatagttgtttggccccttgttctttcccaattttcacacattgattaatccaacaatcaatttttaactctgcttttcctgtagacttggatggcctctaatgacttcaagattcccttttccgatgccacctaatccgtagtgtagctttagaagttcatgaacaacaagcttgtcccgcaagaataaagaaataggtaagtaattagaattcactgcaattcaataaacaaacaacataaaagatttaaagaagatttcgtactctagtttgaaacccaaaacaccatcctctttcctcacttggatccgaaattaacattaaaatgaaataagagatgaaaattttggatggagaagcgtgaccatttatagcctgatcttggggtagatagctaaattgtgcgcgtgagtcaaagagcccgtgatctccaaaaacgatcataccctgctgagctctttcagctcacattgtactgttctctggcttttatagcttcttacaagcaaagcacatgtgaactgtagttactgtactatgtactatttacttaaaagcaaaaaaaaaaaagattcccgctatgagggtgaaagagccaaaacgtttcattcaagggacctatctgcaacaacagaactacagggttcacccgcaattcagcgacagtgcgggggtctatcagcaatttactctagttctaactcctgcaacagagcaggacatcgagcatcaaaacaagccacatgcctttgagatctgctgtctgtggccttttgactttacacgtgttttagcttgttgataagtatgctcacaagaatacatgttcatataaattcttgaatatataaaatatgtttagttcaaacaaacctgaggccacccattatgcaacctcgcatttctaaccactgacagaatagtttcaactttttcaaatgcgttagaaaacgcaatggtttccttaagtccaaattctatgatcgaaacttaggggaaaaaaatcttaataacggtttctgaaaatatataagacccaaaaaagatcctgccatgccgagaacaaagatatctacttctctatatttgtaggaggatccttgatgtgagaaattgttctatagcatgttcctaatatgttttctaatttgttttggtaacatgttattagcatttctaatctgttttggtaataggattctaaatctattttggtaataggttattaggattcctaatctgttttgttttttggttttagaattcctagtatgttttttgttttaggatttctatatatatggaacgattggaagagagaattgagcagcgaaggggatatttggtgcataggggatgtttggttcgctattataaggggtggaaaactcagaaaacccctccacgtcagatttttagccatccacgtcagctttttttgtttccgtccatttctttgtgccgctttggttcgctcgaatggaagagggaaaactctgctgaaatcgccgccaactaagatttttctctctctccgatttccttccccaaccaagtgaaattgataaaaactctgtcacgtcagatttttttccttctctgctttgtttacaaaagttttcttttttttcctatgcgaaccaaacacaagaaaagtaaatacattggtttcccaccattttttatgtgcgaaccaaagcaaaacaatctatttcttggaaaaatttgaaaaactcaaaacttgtgtttctttacatggaattgcatttctctatatcaaagaaacgaaccaaacagccccatagaaaaaaaaagattttttttagctattggttagggttattgtttgagagattgagagctttgttaatgagataagttgattggtttgagtgatcttgtaatctcagtttgtactctccttctctattagtgaaaatcgcatccccttttggccccgtggacgtaggcaactttccgaacaacgttaaaattggttgtttgtgttcgtgccgttattttgaattgtttgtggctttctctctcggcgattggtttgatttctcgaagcacatcggttgattggcttccgccgcacataacaatgtaaaagtgttctattatttgcagattattaaacaaacgacatgaataaaaaataattgcatgctacgacacatgttcgtgttattaggtacaaaataaaataaacatctcacaaatacatgccgcggttttcgagatacattttcatgtatagaaaggccttctcaatgcatgctctacctatacttaggactcatatcacgctgcatttatgagacacgaaacattgacgcaatctgacaaaaaaaagttacaaattttgttacaatgagctctccttactaacacgcaattgccgacagattgtaaatttagttacatatcacactttcacactgatagcttttcttctatacttccaaaatacagccatcctccatccattgatgatgaatgttttcaacctttttagcttttgacaataagaagtatattttcttgttctagtatatttttatgggtttttacatgaagataatcttaacttttgtctaaattatacttaccacttttaaccaaaatcacatacatgtgcttatatatttgcaatgtcacttgtttcactattcagtttaaaaaatttctataatgcttatttaggtggaggatatggtggagaagatggaggaggagggagagagggagaggagaggannnnnnnnnnnnnnnnnnnnnnnnnnnnnnnnnnnnnnnnnatactaaaataggaaaaacacctcatggacccaaaaatgggacagatagagggagacagatgaggtgtccccctctgattgcataatgagctggtaatgaccagctcattatgcaattaaggggggacacctcacctgtccccctatctgtctcatttttggatacctgtagaagcacccctaaaatagatatgctcaagacttaagtgtaataagtgctcaagtgtaacaagtgctagcacttggcagtggattcaagtgtaacaagtgctatcaggtttccacctgtataatgttaatgagactactctcttcgaaattatgctctcacgctaagaaatgaaattttttattaactaaatagaactttgatgctttataatcactcctttagcatttatatactcttagttgtatttcatagcatttatatgccctgagttgttagaaattggaaaattaataccctttgttatgcaaacttgaaatttatcctaattatagttttaaaatagagaatttagaaatacttggtaatgaattcaacaaaaagtcataaaattagcatatgaatgttatatatgaattattggataaaaaaatcatatttgtaaaacagagggtattaatgtgctaattttgaattactcagggtttataaatgctaggaaatacaactaaacatatataagtgttaaaagaatgaaactatatagtatttaagtgctatttagccttttttttatctaacccgtcgaagtcagggttgtggatcttctatctttagttagattttgctgggaagggaaaagctagaagacaaattctatgagctctatttatatttatctatgctactatacaaaaatcaagtgagacaatcaaaaaattatgggaaaaatgtttcaaggccccaaaaccaaaaatcggatgtggcccagcccccccaattatctgccttagccttcagccccaaaaaattgcgaaaattaattctagcttttttctaataaaaggacatttcacattcaagcaatttgttgtgtacagctaagcattccttttccttgaggatgaaagaatgacttagtggattgatctgaaggttccttgttgtgtacagcaatttggtttttctctggagagtaactctcgcaaatcagagacccgaggacaattcttcatcggggatgaaaccccctgtccttggatgggcgaaattggttcttgttgacattaatgaaattagggtttttttcaactgtctacagcccttttgcacctgaaatcccctcaattactcatcaactcctcataattgccttcattactgtcctcataactttcaaccacccctaatagccgccaatgacttgatttgcatggtgtctttaggcgagaatgccatattcgtgaagctaagttcgacaacaagctttgatgaactccaatttgatgtgtctgaaagattgaaagtacctaaagaagctttatcctttatatttaaatctgagaggcaccccaacctcagtttttcagttgacaacgatgatgatttgaagtgcatgttggagcacaatcgaaatattggttgtacggagattcacatgcaagctgctgttaatgtagagtgttccacttcaaggaaaaatcagattagggaaatgtaagtaattaatgaactctttataacattgggttttgtgtgatgtaaacattgttatttttttcttcaactttcaaccatcccttatgggcatcaaatccctcaatgtaagttattaatgatttgtaagtaaacaatgaactctgtcaggaacaggtctatgtgtgatgataagccaattgtgatttcaggtttcgatgctaacttgggaaaaaatagttgtcatctctgatggttagatgttaactcttcatcttacaggttaattttccaagagatatgttaacctttacatgaacatgttaattgtcgtgggaacatggttaattttacacccagttagttaacttttgttgtactatgttacctttggtcctactgctgttaacttaaattatcagaagataatataacatattgtgcatgatatctcactggttgattaatttgtgcagtagtgatgcctctttgaatgcagaatatagtcgtcctcctccaggaaatgcatccaattcagagagaatccaaaatgatttcccgtctggtgaggttgtaatgagagctgatgatattctcaacaacacttccagcattcctcaataatgggggtttagttaccccattagtcgggtgtaacaacccactaaagccactccttaaatcgtgggtgaagaacagcttcgaagttgttatgatcacgtttgaatgagtcagaaccttgacctgcgttctggcggtgattgagctgtgttgggcagcgactgacgggctgcgttgggcagtgatggatgagctgcgttggcagcggttgataagctgcgttgggcagtgatggagctgcgttcgagctgtgcttggcagcgattggagctgcgttggagctgtgcttggcagcgattggagctgcgttcgagctgtgcttggcagcgattggagctgcgttcgagctgtacttggcagcgattggagctgcgttcgagcagcgattggagctgcgttcgagctgtgcttggcagcgattggagctgcgttcgagctgttgattgttgtagtatttagatttctctgtctttatatatggatgacaccaaagaccagtaaagaaggtcttattcaggccatttgtgacaattgaagcatctcaataacgctctatcaactgcaggtcatgatctccactgagtgtgtcgaatatcattacactgctcatcagcacctctaatggttgctaatataatattagtcatgttgttgtcgcagccatcaagatcaatcatctcacatatgaagctgcattcgtgtttgtagctgttgaagcggcataggtgattgaatcggtgtagtgtcttgatgatggtacgcggggaggactttcacgtcttggtttgaagagatcgttgatttataatccctttctgtcagagtattgctaaagactgtcgttttgtaacctttgctttaactctttgacatgtaatccctttctgtcagagtattgctaaagactgtcgttttgtaacctttgctttaactctttgacatgtgaaaatcttcgaattgtagccttctggaagtcgtcagattgtaacttccatcatcagtgttcgatggagactcagctatctattgtggtttttagacagcctacagctcccaagctctgtgccacgccagcccaaagcagctccttctgagcttgctagagagagttcacgagctcccaccgccacgtaggacttgagagtgggcggtgggagcttgatggacttgctcttagcatattcttgtgagatacccatgtgagctgtcacatggtatttactatagctttatatacctaaagttcatccaaattacaatacaacgacccctctcctatattacttagtttctaaatggggaaggagcattttagtgtttatgaaaaattttagggaaaaatgtgtccaggccccaaaaacataaacttcatgtgctgcagccccttctagtttcccccatgtggttcagccccttgaagtgtgacgttttgtgctgcagcccctttttaacaattattacatgccaactaagctaaaatccccaaaataaccttaccccctctcctcaatccttcaaacccagttctctctctctctctcccccctctctctcccctctctctctttaaaaacaagggttttatcaagctcgtcgctctggccctcgccctcctcgccgtcgccacctccgcccaggctcccaagcctcccccgagttcgtcgccgcctcccctcctctcctccgcccgacctcgtcgcggtagctcgccgtcgctccccatctcgccctcgactacgccggagttcgtcgctgtgcctgccacttttgaacccatagtatggtaggccggaggaggatgaccaagagaaaagagtgcatgatgctcaagaaaagtaaaaatgaaggggacagaatagaactaacattgtgcagattagaactaacactgtagacagaatagaactaacattgtagacagaatagaactaacattgtagacagaatagaactaacattgtagacagaatagaactaacattgtagacagaatagaactaacattgtagacagaatagaactaacattgtagacagaatagaactgtagacagaatagaactaacattgtagacagaatagaactaacattgtagacagaatagaactaacattgtagacagaatagaactaacattgtagacagaatagaactaacattgtagatagaatagaactgtagacagaatagaactaacattatagacagaatagaactaacattgtagacagaatagaactgtagacagaacagaactaacattatagacagaatagcatattcttgtactttaacttggaactagatgcaacttatgactctgtctagtttctggtattggtttatgattcaacaaatgagcatgctcatattctttacagaaatttacaccctgtcattagattgaaatagagcattctggctgtttcgtcattggttgacaataacagtatcagtttcttaatgtgttcctctgcctgtttaagctctcgagctggacttctggattactatagacatgtagttcgtttgcatacaagttttagtggtttgaaattgactacgtggttacagttttctattttggaaatgggaacgtatcgtaaatcatgcagcattttgctccttggcaacattttggctgactactattctcaattctgtaaacaggaaccatgctttgaaaatgggcaaaagcagcaggaagactctacacaattgtcacgagtgtgaagaatctgcgagacatgctggaatgcctcaatctttacttcgaatcccttcaaccaagtttgtaattgacccaacaactttcttatagggtgattgtattttggacaattctggacagaaataattgtggttggtaacaacagaaattacaaactcaataagcggcacgaacttggttgaagggattcaaagtaaagattgaggcattccagcatgtctcgcagattcttcacactcgtgacaattgtgtagagtcttcctgctgcttttgcccattttcaaagcatggttcctgtttacagaattgagaatagtagtcagccaaaatgtttccaaggagcaaaatgttgcatgatttacgatacgttcccatttccaaaatagaaaactgtaactacgtagttaatttcaaaccactaaaacttgtatgcaaacgaactacatgtctatagtaatccagaagtccagctcgagagcttaaacaggcagaggaacacattaagaaactgatactgttattgtcaaccaatgacgaaacagccagaatgctctatttcaatctaatgacagggtgtaaatttctgtaaagaatatgagcatgctcatttgttgaatcataaaccaataccagaaactagacagagtcataagttgcatctagttccaagttaaagtacaagaatatgctattctgtctataatgttagttctgttctgtctacagttctattctgtctacaatgttagttctattctgtctataatgttagttctattctgtctacagttctattctatctacaatgttagttctattctgtctacaatgttagttctattctgtctacaatgttagttctattctgtctacaatgttagttctattctgtctacaatgttagttctattctgtctacaatgttagttctattctgtctacaatgttagttctattctgtctacaatgttagttctattctgtctacaatgttagttctattctgtctacaatgttagttctattctgtctacaatgttagttctattctgtctacaatgttagttctattctgtctacaatgttagttctattctgtctacaatgttagttctattctgtctacaatgttagttctattctgtctacaatgttagttctattctgtctacaatgttagttctagtaataattgttaaaaaggagctgcagcacaaaacgtcacacttcaaggggctgaaccacatgggggaaactagaaggggctgcagcacatgaagtttatgtttttggggcctggacacatttttcccaaaattttaatggtagcaatgtttattaatggggggttattagggcaaataatagtcacttattttcaaggttggtaaaattatatggcatttttctgcaatttagcctaaaagctatccacattgttaattggcggcaatgaaagtgctactggcggcaatgaacaagtagttcaaagagatgtcagtggtgctgatggtaacgatatagagttggaagtgtttatgggcttcgatcgtcataccaacaatatctgaggagtgtgtgacccagctatgagccaaggaaaagcagttgagatcgtaaggagtacgtcgggaagacgataagtgattggcaattgacaagtttaaagtattttgcaagcattttattttgggagactgatttgtgtgaaatgtgcttgatgaacaacttattgtgtctacgtgctgctgacgtgtgtgctcgcgctttttttcttttttcttttttttttcttttttgacacacagctcattgcatcaatgtgcttattgtgttgtttttgtaactcacagttaacacacagattgtgtgtgtaaacttaaccaactagctcttgatattggatgctctaattgttatattttgatagacattgtagacggttaacagtattttcaaccaggccaatgatcggtgtagatctaagaagtgaacgcccatgggcaaaacactttaaataagcatacaactgagcccacaataaactgtagcgaagattgcctaaccaatcaagccaacgtcgctgaacaacccatttcaactcgagtcgaccaaatcaagagcgagtcgactcccgaactgcgccccaggccaagtcaaaaggcatcatccgtaggccaaatcatgagtgaaattatgtgtcaacttcgaacttatagacgaagtccgccaatcgatgaacttcgctcataacaacccaagtggaccaagtcatccacactttcggcgaacctcgcccaaaagtcttcagtagcgaacttcacccaaaagtcttcggtagcgaacttcgcccaaatgtcttcagcaacgaacttcgtcaaaacatcttcagcaagtttcgccaaaatgtcctcaacgagcttcgccaagtcagcgaacctcgtttaatagccgtttgagggctatttttaaaggataaatcccactattttctattttaatggccacttaatccataattaaaggtcattagctctctcttttaccctataaaagtagggaagatcattcatttttgggcatcatcgaaggagatctatagatctagccacatgcatagagagatctactattgcacttacaattctattgagaagatctgctaagagaagactgagtcgttttctaagcaaccaaactcttatcaatagcaaaagacttgttgtctcgacctgtgcattaacggagtacaagatcgacacttcaacggtacacgaaaaagaatcccagaaaaattcaaaatttttcttaatttcattataattctttatattgtaatctgagttaattgcaatttaaaaagccccgaaatagacatgatgatgatgatgatttttaagcttcagggttaattgtacatacaggtgcctagtttgtcatttgagtttatgaatttagcgtattatatatgctcaagtgctttaagaagaaagtgaagagtactagattatttgctatgtaatttataccttgagacaaagatacatggtgtatatagtataaaaataaaagtgaagagcactggattatttgctatgtaatttataccttgaggcagagatacatggtacatacaagtataaaaataaaattcatagaaaatgtaaaccattggaggagcataaaaattttgaaaggtctgtgattatacatttttttggtcatttcctattcatatctaagtcatgtctgtttcgtaaatatctgatttgtatttgtaattgtatctatatccatttctataatatccaaatcatattcgtttctgatttaatgcaaatttactcacaaaagaacatccttatctttttttagaaggtgaatatgaagatatgatacatgtcatatctgaaccgaatgcacattgagtattggaggaggggggaggcaaagaaaattatggtggaattttgtgattattaatgagtaaattcctatttagcgtgtttagtaaactgggacccatgaaagctgggccgttagattcattcaagaccagctgaagatcgctacaagaaggggccgagacagcctagtgggggtctgtgttagaattaaaaaattaatgacttgtttagatgataattttggtattttgacaaaataaaattcttccatgtccccgagttcgtagcattttgaaacaattccctataaaattatttacattttcattgttttttatttttattttttttggtaaatgaaaaattttattcatccaccaatatgaaatttttgtatgtacatcaagaatctcatcacattttgagatatccaaaacctgtaactaaagctcaaaagaaaaaactcatatatacagagctttacaaggagagtaaccaatctctcttctcaactggaatttgagtgtttagatttgtaatcaaaatattcatctttatatctttaaccaaacactccatgcttctatttttgttttgaaaaatcctggcgttcctttcactccatatcctgtaaattgtagcagataaagtcatgcgcttgatcccttgcttatatcatctgcccctcagctttgtgcaaaactaatccaatagaagtccccactcacatgacttccaagtgaattaaagccaattcataatgcaattccacacctcatttgaaaatctgcattcaaaaaatagatggtttcgactttctaaacctccaccagcacataaactgtaaacatttgtattaatgactcccctcttcatcaatctatcctgtgtgagcagtcgattttgcacagcaagcaagcaaatgaatgagtgttttggataactcatcctttcccaaacggtgtcatgctaaggcactctttgagaacaggggagagagaattgtataagaatgatatctgagattttgatttattgaaacaggagctcaaaagctgcaacagaattttaaccccgccataggaaatcacagctttatctcttttttcaacatttgcttccacatccaagaatcaccatttttagaagtaacatgtcagatatcattttgcctcaagttagtcccatgaacccatttgatccaaagggtttccttatttgtatgaatgaaccataagttcttcaaagctgctgccatatttcaaattgaagcagaaaaaattcctagaccatcctgttttctatccagacaaacagtgtcccaagcaactagaggattttttgaaggttgatatgttttaccccataggaaattcctacacaattcatcaaccttttgtgttactttgacaggtagtatataatttgaggtccaaaaaacctgcacacccagaattacactctttataacttgtagtcttcctgcatatgttagctttttgtgttttgaccatgtgagaagctggcttgatactttgttgataagtgcattgcaatccacataagatagattcttgcatatgagtggaacccccaagtatctgattgggagactaccttctttgaagcccagaagatttataatagcagatttgaaagtgtcatcaactccaccaaagaaaactgaacatttatcttgattaacttcaagcctagaaatttcaccaaatttttttaacacactgatacaaattctgcactgagtatgagtcagccttcccaaataacagcaggtcatcggcaaagataatatgtgtgagctttaagttagcacggttgggatgaaatttgactttcttgtcaagctttaatacatccaaacttcttgataggtattccatacccaatataaaaatatatagagaaagaggatcacattgtctcaaacctttctcacccttaaaaaccctatggagagaaccatttagagaaatggagaattttgggttagaaacacatatcatgatcatgtcaatcataaaatctagaaaccccagccccttgagcatagtattaagaaaatttcagctaattgtgtcaaaggcttttttgatattaatgtttaacatgattctaggagatatatgtttcctactatatcccttgattaattcatgtgctaacaagatatttcttgttatttgtctgcccttaataaaagcattctgtgcttcattcaccaaataacccaaaacaaattttattctatttgccaagacttttaagataaacttgtataggctattgcagcaagaaataggcaaaaactttgctggagtttttgggcattttaccttagggataagtgtaattgatgtagcatttaccacacccaaaagtttaccagaattaaagaattcctcaatggctaaagttacttcttctcgctcaatcagccatgccgatttgaagaaagaaataccatatccattaggaccaggagaattgttatcagacatggaaaagatggcttattttatttcttcttttgttacaggttttgagagcagtctggcttgtgaactagacaaacatggaccagatttaataatctctatatcaggatttgtagtgtctgatgctttccccatgaggttttggtaatatgaaacaaattcattaacagtctcatcataatatgtaattctttgcccagcactattatagaggaccatcactttgttgtgatgtctatttatattaatgatagagtggaaaaaatttgtgcatctgtctcctttgatcccccaggcaattctagcttttttctaataaaaggacatttcacattcaagcaatttgttgtgtacagctaagcattcattttccttgatgatgaaagaatgacttagtggattgatctgaaggttcctttaaacttattccaaagcttgcctagccctcaggacttgttcactgatgttggggaaatacctcttgttaatatccttgagaactcctttcaggttttttaactttgtacaaactgaatacattttgtaacctgcaatatcagttccccaagtgctagctactgcaggtaggaatctatcatgctttgcccactattaaagaatttaaaaggtttttgaccttgcactctgtcctcaaatatagaaaccaaagcaggagaatggtctgaaaaattagagagatggaactcagcctgactagattggaacacatgcatccaagaatcatttaccagagctctgtctagcctacaccaaatccttgaattagtgtcttatttattatttcatgtgtagaaacacctaattgattttaggtggtttaaaaggcaatcatgaatgaaatccctgaaatccctgaaatcaacctcagtgagcaaagagcctctcagtttctcatcattgctaataacagagttaaaatccccacacaagagccaaggtgtagttccaattgaattatgaataagctttaaaccagtccataactccctcctggcttctatatgatttaaaacataaactgttgagataatactatcaaatctcccatccaaagatttaacagagcatgttatttgttgaggtgagagacttacaatgttaatgtctagaatatttggatcccacaagatcataattctggttttactagcataaccagagtttgaaagataactccaattgctagcaattttcttggctataaaaggcaacattctgtcttttatttttgtttctaataaatctaggaaagatgggtgatactgagctatgaaatgtttcaccaaatgctgtttagaggacttattcagtcccctaacattctaaaatgtaaggttaatttttttaaaaccagccctcctctatcaattgtagagggatcaagtatcaaagagtccagatgagaaaatgtattgacaggagcaacaggttgcttttgatttcttctttggatttgaacccaaaagctttcagcttgagaagatcctttccctgaattcagaacatgcacagcatgcgcaggctctatgttctttaatcctccagcaacatgtgttggttctcccttagctaatatagacttgaaacattttgttgaccatttgtttgtgaattcacttgcatatgttgctgcccatatttagaatatgttggttctcccttagctaatatagacttgaaacattttgttgaccatttgtttgtgaattcccttgttgctccctccagctagattttgatcaaaaatttccacttcattgataactggatttggtgcatcatggatagtagtatttccaggtactgttttttgtttggggatccatttttggactctatgcatcttcctgcaaaaatttatgtcatgtcctacaactttgcacaaatcacaccatcttggcttaaattcataatgagccatttgatcataacttttcccatcaggcccttgtaatatgatatgatcagatagaggagaaggcattttaacatccaccaagactctagcatatgccgacctttgtttattagcagtcaacttatcagttgcaatagacctactgtaggcattaaaaaatgttgaaagatattcaaacgcagctcaaaaggaagtcatccaaaaatcaaaaaaggacacaagtatagactgtctcgcacgcgagacagtgttcactgtctcgcacgcgagacagctttcaagcacgcgagacagtgttcactgtctcgcacgcgagacagctttcaaaggttcagaactgttttataaccactgacacgtggccaccaactgttcaagaacgtgggaaacgtcgtgggcgagaatcacattgataactgctaagataacggagttttaaaacgtgggaagacagttacaagaaaactgtcgggcagttgaagatttctgagacagtatttactgtctcgaaacccgagacagtgtttactgtctcggaacccgagacagtctttgctgtctcgaccgccgagcgccgagacagcaaatactgtctcagaaatggttatttgttcagggactataaatacccccctgagatcgataaacaggggggctgagcatttttagagcagatagagcagagtacttgagcttctggcaattccttgagattcgagctttgacttgatcttaagaagaacgatcgtcttactttgatatgatcttcgtttcaaattctcactttgataaatgaaggaagaatcactaaacccctcacgatctgtgatttggtggtccacgggctaacgcacccccggcacaggcaaagatctcacacaagcagcgatccaaacaacgatcctgcgtttgtttctaaaaagttataattttccttttgttgtgtaaaagaagtcttataaaaaggctatttttttttaatttgttgtaatcgagcgaagatataatgaattccacaacgagaccaacttttgacgaaaacaaactggcgaccacagtgggagccaacggtctcgctgccgagaccgtcgtgtcgcagccgatcaagatactggttgagtccatggttgaatatgaattcgaccaagtaaagtttgaggaatatctgtcatcctcatcctcaaagtcttcctcgcctcacaaatgcaggaagattccatcttctaagaaggtttttaagttttcgactccgtcgaacactacagatgaagactctcgcttgattgttgctgaggattctactcgcaacctctctgctcacaatgactcttatctagttaaagagtcatcgaatcaaagcccaccggcactgacgaagagggctcgtcagagacaacgtcagcgccgcgctcgccaaatagctaaggccttggaacaaaccgacgggattcgttatcacgcggacctagagtcgaggaggtatcaagtggttcagttgtctcaacaaccaatcactcatatctctgctaaactaatgacggatgaatggacttttgtcaagaggactcgcttaaccctcaaagaatgtatacagaagcgtcgtgcaaacgctgctcatgcccgtgctctcttacaacaaagacgagaaaggaacaagaaaacggtggccaaagaaccactaaaactctacaaagtttggattccaaagtctggagttgtacaaaatcagcattcggagcccgttaagactccgcacccgtaagggggtggttctaaacgtgtgactcctgacataaccttggatcgctcaaatgcgacaacaagttgtcctgagaatgccaataaggctttacacccacagaaaaagatgtgttcgttaaaagacatcgttatacctgggaggtcataccaacagacgatcggattttccggcaatcataccgatgagtcgtactatcaagctgtaggtgtgaataaatttcgaaagagaattattcgagaaataagctctcattgttcctatgcgcgactcattagaggagcatttttggaatatgactactccaaacgagaagccatcccgcaaaaaatctcagtgttccagaggctttttaccaaaatatcaaagcccaagccgagatatttccgcaagaagcttgctgttcaggaggatgaactctctaaagtcatcatcaacatggttgataagaaagtctaagcggcattcaatggactcaaatcccgacttttccccgagaggaaaagtcaatccaagaatggctcaacggatgtctcgactccagttagaagccatcagacgtagggattacaagagaatgcatgaaggaatatcctcggaggatgaactttcagacacttgttcagccattgcttctgatgatacaatgtctagcacgggacaaaccaaagaagtgttcacaatcacttctgatcaatttgctcaaatgcttcaagaagctctagccaagcaacgtgaagaaattagagctgagatgaagacagagatggagttggctatccaacaaatgagagaattgctcgctcaacggcctcaatctcctgagtctagtcagcgagttaaatccagccgccacactcagaatattgtagataacagtgatccaaaagtggatgaagttattatggctgatacacctcccaatgacaataacactgggggtggttcaacagatcctcccaacaacaatattgggggtggttcaatttcacctcttaataacactgggggtggctcaattatttctgctcaacatcactcaaagagagatgaagatgaggacaagaaaatgcaagaccttgaaaacaaagtcaatgctttgatgtccgctcaggaagtaaagaagacgggtattccgtatccctatccaagagaatgggattcaataccgtacccgacaaagttcaatctgattaacttcacaccatttgatgggaagagctcgcctacttagcacttgatttatttcaagtctcatttgggcatgatctctggaaatgaggctttaatggtccggtcattcgttggcacccttcgtgggcccgccttcgattggtaccgacgtctcaagccagggagcatcaattgctagaatgacatagaaagtttgttcctcagcaatttcttcgatgatgacatcgaagtgtcaatcggaacccttttagatgagaagcaaaaagacggagagtcagtcgataattttgtcaaacgcttccgtaacaaagcaattaattgcagagatcctattacagaggagtttatcctacaaacatgccacaataatctctccatcgatgtcctggaagccctgggggtcataccatccaaaacttagaaagatttgaaaatgcgcggcgaacaagctgaacactttcttaaaagaaagaaagctgagagaagccgaccgacgacatctacaatcactgagaacgcgactctcgatccgaagtttcaaaaggagtattctttcgaaaatgatgaagctccagccatattgaaatacctcctcgccaataataaaatcgagctaccacctattaaagatcaagagagagctaagagaattacggatctaaactactgtgcgtaccacagaagggttcttcatcctaccgagatctgcttcggactcaaaaacaaaatccaagccttaattgactccggcgtcataacggcgaaacaagccaagtaaagacgactctaactccattggatacacgagtataaattgtttcccctaactccgaagagtatgcgagtataaactgcttctcaagcctccaaccggtatacgaggataaactgctccctgaaactccaataggtatattagtctaaactgtttcccactcttgacgggaagttcctggagaatttttacatgtaatattcttaaggatatcctggagaatttttacatgtaatattcttaaggataacctggtcatgtaactcagtatgatataaacctagtttcgtagagaaagctgggggtggatggttcatgtaacgggaagttctcggaagaatgctatatgtaattttcttagggataacctgatcattacaaacaaagtgataaacactacatccccacggtgatttccgaatactcttttgctgagatgagattcgatcacttcgttggatcaatcttccgtctcaaattctcatttggtcaaacatttaaacagttaggaccaaagccaaaatcccctctcgattccttcaatgaacgagaggtccacaaatcgaacgatcaaaccttcctacagttaggatcgtctcaagttctcatttggtcaaacctttaaacagttaataccaaagccaaaatcccctctcgattccttccatgaacgagaggtccacaaattaaacgatcaaacctttaaacagttaggatcgtctcaaattctcatttggtcaaacctttaaacagttaggaccaaagccaaactcccctctcgattccttccatgaacgagaggtccacaaattgaacgatcaaacctttaaacagttaggatcgtctcaaattcccatttggtcaaacctttaaacagttaggaccagagccaaaatcccctctcgattcctttcatgaacgagaggtctacaaattgaacgattaaacctttaaacagttaggatcatctcaaaactccgacttggtcaaaccttactacagttaggaccacaatcaagattccctttcaattcatttcacgaacgagaggtctacttttgaattgaataatcaaaccttatgacattcaggattattcaaaccagtccagattctctaagtggagatcccactttgagtttcttttgcaccaggagattattcaaaccagtccagattctctaagtggagatcccactttgagtttcttttgcaccaggagatagaatataaaattaggagatcccactttgagtttcttttgcaccaggagatagaatataaaattcttcctctccgatttttgggtttatatctaccaacaaaaaagagacctggagatagaatataaaattcttcctctctgatttttgggtttatctctaccaacaaaaaagagacctagagatagaatataaaattcttcctctccgatttttgggtttatctctaccaacaaaaaagagacctggagatagaatataaaattcttcatctccatcatcgggttcacctctaccaataaaaagagaatagaatactccaataggtatacgagtctaaactgtttcctaatctcaacaggaagtttctgaagaatatcactcagaatattcttaagaataacctgaatactccaataggtacacgagtctaaactgttttcctaccctcaacaggaaatttctggagaatatcatttagaatattcttaagaataacttggctacctcctaacgagtatatgaggttaactatttctcgaaaacttcaaaaaatacatgagtataaactgtgttccagcttcgattcaagacttcgacaacggtcaagcgataaacgtagcaccggaagaattttgtctattctacaaagcaatgaatagaccaaaggatgaagaagtcaagagttgaagccgttcacaagtccttctatacgatatcctcagttaaatactgaagtgattgcaaacaaaacctgtctcatccaaagtgtcccagactcctctataaaggaatgagtctagaacactttggagggggtatctgtaggcattaaaaaatgctgaaagatattcaaacgcagctcaaaaggaagtcatccaaaaatcaaaaaaaaggacacaagtatagactgtctcgcacgcgagacagtctttactttactgtctcgcccatgcgagatagtctttactgtctcgccgtgcgagatagtgttcactgtctcgcacgcgagacagtgttcactgtctcgcacgcgagacagctttcaaaggttcagaattgttttataaccgccgacacgtggccaccaactgttcaagaacgtgggaaacgtcgtgggtgagaatcacgttgataactgccaagataacggagttttaaaacgtgggaagacagttacaagaaaactgtcgggcagttgaagatttccgagacagtattttctgtctcggaacccgagacagtgtttactatctcggaacccgagacagtctttactgtctcagccgccgagacagcaaatactgtctcggaaatggttatttgttcaagggctataaacacccccctgagatcgataaacaggggggctgagcatttttagagcagatagagcagagtacttgagcttctgacaattccttgagattcgagctttgacttgatcttaagaagaacgatcgtcttactttgataagatcttcgtttcaaattctcatttcgataaacgaaggaagaatcactaaacccctcacgatctgtgatttggtggtccacgggctaacgcacccccggcacaggcaaagatcccacgcaagcagcgatccaaacaacgatcatgcgtttgtttctaaaaagttgtaattttccttttattgtgtaaaagaagtcttataaaaaggctatttcttttgaatttgttgtaatcgagcgaagatataatgaattccacaacgagaccaacttttgacgaaaacacctaccaatgatacttgcaatcttgctaatacatttagaattccacaaatttagtttcaaagatggtaattgaatccacaatggataaatgcaatcatcagatttgttaatgtctttactaatagaccaaggtttcaaaaaaaataggtctagacccaaaaaaccatggacccttacttagaatttcattcatttcatcttctcccttgaatttgaacaagaatagaccagcttttagaagacaaacttcaggaacatgaacccagactttgttcacatagttcttcattgccttaaacctgacatttaacccccagacctgtccaattaataagaatttcctcattgaagctccatcattccactcatcttcattaaaaacaactgaatcagttgcctcagaaggcacataatccaataccataccgcttctaggcttcctgttatcaacaaacaagctgatccaacttttggctggtttgatttcaccttcttttgaaatttctaaagggggaaactctgaaactatagactcatttgaagcatttattccttctttcaaattcaatgaaacagtaactttatcagcatctaaatttgaatttaaagatcggtataaaaaataggtaaagttcttgaagacaaataaaagagtggaggtataatctctgatgccgattcatcagcccaagaaaccctagctgatttcatcccttcattacaagacaaaggagacttatagagattttgagcttgaattccattcaaaggagaagttccagcttgaattagaaatggatcaatccaagaatttgcagtattcagcaactccgccatagatttcgatttctttcctcccttcggaccagtagatcccattagagaacaatcttcatcatctttatcaaatcttgtatcaaaatgttcatcagaagtgggcaaatttgaattagaggctctcaatccaatgcttaggatctttttcccactgttcttcttcttcctcaccatcgaaaactcggcgggggcgcaggataacaggagaaaattcgcctgctaacatgcaccaaaaaaaacgccccttagcgatcccgactaatttacattgttattagatccctcagatcttataatttgctattgctattattaacttgagagagaatttgaaaagtataagaattgagggacttaatatcgatttcaataacgaggaactgcttttgaaataaattataagaactagagttctaataacaatttcaattatttgagaaactaatttcaatatatttaacatttaagtgactaatatttaaaaaaaacattttttatttgatggaatcaaatgattcaaattaaatttgagtctaatttttctgttttggaaatcttctagagaagtaaagactttctaagcatgaattttcttacagtaaattcgttacctctccaattaccttcgaataaaaaaaaacacaaaacttttattgagaattttattaattgatgtgagacccatgttttctgaacaatcaagcgtaagcatagacatgaaaacaaacgaaaacaattaatggcataagatattattcctaactgttgtaatatactaaagaaatgaaacaagagacaagagacaagagaagaagagaaattgtaatatttcttcatcaattccattttcatacatcgtacaatttatagatacatgatggaagataaaaggacatcaagttaatagttcacatacaaagtaatgtccacataattttgtcttttagatttcaacaaaatgtcttttagattttaacaaaatgtcttttagatttcaacaaaatatcttttagatttcaacacttccccttgtacattacttcgagatgtcaatgcctcgttaaaaacctcgctagaaaaacctaatgggagaaaaactagtcgaggaaaagagtacacgacataagtagattcttgtgtttcattagttgcctcattaaaaacctttagctaagaaaaccatgtgggataaaacttagtaaaggaaaaaaaagtgtacaactatagtccttcaatgcgcaatcttcaaggcactcagatagggaacttctggccctcacatttcttcattatcttctttgggcctaaataggtctttatccacttcaagggaccggacgaccatttgtgtgctaagtgaatgagatttatctatataaaatctttccaaagcttttttcacgtaggtcaactggtgtagaaaaattccttctgggaaatgctcgatctgtaggtcgagacaaaacttggtttttcccaagtctttcatttcaaactccgtctttaggcatgagctagcttctgtaagctcattgtgcatttcaataacatttatatcatcaacatagaatgagatgatacagaagccattttcggatttctttataaacacacaagggcagacatcattattttcatatctcctcttcagggggaactcactcagtcggttataccatattctacccgactgtttcaagtcgtataacaacctttgcaatttaatactatacatgttgcgattctcgttttctctcaactcaggaattttaagtccatcagggactttcatataaaaatattagcgtctaatgacacatataaaaatgtggtcatgatgtacatatactgcatatataaattcataatttctgccataggtattaacttgtggaacgtaatacaatcacttataggagaatattttacatctaaatcgatgccgggtctctgcgtgaacccattgagctatgaatctcacttaatatctcaccaccttacaattcttatttatttttcttacgaagactcatttatatcctgcagggatatatggactacaggttcaaaatactttagtgagttcagctcagcctcaattgccactttccatctcacctagtccgagtgcttcaagcactctgctaccgactggatccagattattttcaaagatagtaagagcaactgtagaggcaactatgttgtcgacaacttttatatttttattatatatttctcctttttcacaaatttgtggctacttcaattcttattttatgtcaaccaaatcctcgtcatttcccttaacaattggatttggtcgttccgcatctccagtattgtgattatcaagcacgtgcaacttttctggagattccatcttcaggatgaacctcttccggaggttatgggagtgactgtctttctatatagaatttagtttgccgcggaattttaccttttacactaacatgttttaaatgcttctggcacagtatgcttctggcataccaaatcatcaatgatatacacaacatgaatatggggcttagtcactcttttcttagcagattatcatgtgaacttctggttcagtttgactagtacgtggatataaatattgaagatctttttcaccaatggaatttcttgacattattttgtattttgggcactaatctctccttaatgtcgagaattgatcttcaataaaaatacagtcaacgtaccaaattgtaaattaatcccctaacatgggccataggtgttaaattattgacggagtttcataaataatgtatgtacctttaccgaggtcccatagaggcacgctatggtggtgatatagaaacatagactgcaaataaagaatacgcagatggaaaatgtttcgcttcttcaccatgtattagataaaggggggaaattatgatatgtagttggtcggatttggtttgaatgcctcatttaatttaaggaaatccgacaaataatattttgcccaagatgacccaatagttcatgccagaatttaaaagaatttgggtccctaaatctcaaaaaaaatcatcgcaacatggtgtattttatgtcatacaaattctaaagtgtataaataaaaaccacataggttcacaagagtttaaagcaaactcaagtttataaataaaaaccacataggttcacaagagtttaaagcaaactcaagttaaatcaaaattgtctgacaaatgcatataatccaaatatagaaaacccaaatagtttaccttgaccacctcgataagatgcacttcaatgtccactaccttccctaatccaagtttatgaatattagtttgaattatgacatgtgcttcaggcactacgactgaaccaattaaacttacattatggtttctcacaacagctggttgtgtttttaacaactactaatgcaagtattagttcataatgcttttagttgtactattgtaagagtacaaggttacttgttgaattgtattcagtcgagggtttaaaattcaaaaatggctacaggataagatctcttactatgttcatagcctctccctcgtccacgcgtataagtaattttctgaattatagcatgtgctccaaacacaactcgtaagccaactagtctaacattgtgatttctcatcaataatttattgtgattctctacaactctaaatgtagatatcaaagcagaataattagcataatttttgatcatgtactattactggagtacaatactacttgcatggaatggggaaaaaatttgatcaattctgcgagcttcacccgctagacaatatggcacatggttgaatcatatttagtcatgtatttaaaatccaaaaagttctgattcagtttgccagttgcatttgagggaagattattggcttccatagatcaaagcgatccttcagggattgcccagaaagtgaatactttttcagtgaggcattaattttttatgtcttaattgatagagagaaaatttaaagtgtttgctttctgagaaaaaatacttaaagaatcaagagatataatcgtgcaaaaatcacaagagtgtccagtaaaaatgaacgtttgaggtcaaagacaagtaataattactatcatatatcacagtgcactaatcatggggacgaaagattagtgcgtgagaaattagaaatattcacattttaatgagatcacacataatcaccaaaatcattaagctcttttttctaaagattttcataaaggttatctttcaaatgtttgcttctggcaaactagtctgatattaaaattcacacgaaatttttaatgctcggacgatcaatgaccatcacaaactcaagcaagtagaaattaaacaaaggcataaccagtttgtgttatcctttcttctaaactcaaggttgtcagattcaaaacaccaccaaggcaattttggatagaaactaatattgcataatttcagtggagaagaagaatcagtgcaattagcaataaaaaaatagaccacttatggacgccaacatgagctttaaaaacccacaacttaatttagcaataaaaaaatagaccacttatggacgccaacatgagctttaaaaacccacaacttaatttcaagttgttcatgaggcttagattttacttcaagcaagcaaatagaatatttaaagcaaaagcatcaagttgatatattatgacaattttttcatgattgatgctatggaccctcaactcttttcacatagattcatcatttttcatgattgatgctatggaccctcaactcttttcacatagattcatcaaatgcctctcacttaattgggaaagaaataagcaataatatgcatatatcatgatcctagggactaagatagagttttcttacaggttaagcacaacaaaaatcacttaaagctttcaaaaaaccaaataaatatgtgctttactcgtataataacccagccaccttaatgaaggaataaagaaaaatattctagtgtatttcatacctcagttttttttcttgaatcatccctccataaatttcaccaaaaaattaggataaaggttttgtttttgttgttggtatttctttctctctagcaacctaaccaagtttatgtccttctcggaaagataagtggataatgacaaggatctaacctaaagggataaactttatcttattgatgattaatttaggtccatacaactaaagagcaagcctccaaataccaaacagtctaaaagaagagtgctgtaaaatttgcagcatgctatcgaaataagcaacgatacaatagctacataaatctaaaagaagagtgctgtaaaatttgcagcatgctatcgaaataagcaacgatacaatagctacataaaaggacaagtaactagcacaacgtataaacaagtagctatttgatctcaatggaaattataagcaaaataatcatatgatatgcatcaatcaaaaagaaggataactgtgaaatatgccctttatatcttgtgtaacttatttgatctcataacagttagataaatacaaagagaaagagaaacatatattctgcttgtattcagttactgtgttatgtaatatctttctctccaagtgaataatgatgtatttgagaatctgatcctgtatttatttattgttttgtgtaatcggaaataaccctttatcttagtttctttgtattttctgttaagacttccaggctatgttatgactgatcatcatgtgcataagaacttaaagatcacggatctacatgctaaaggtgtgtttagcagctgcatgcaaaattgtttgttttgaagaattcaaataaatgagatgacaagattcatactggacataatcataatcattcgacggaaagcttgatactatgtaaatagacaaaggccgaatgtattattacattgcagaagatgtacacctaaaaatctattactacgaatcgatgatcacgaaccggctagagctagttgtgctgataacgtgttgtaatatactaaagaaataaaacaagagacaagtgacaagagaagaatagaaattgtaatatttcttcatcaattccatttccatacatcgtacaatttatagatacatgatggaagataaaaagacatcaagttaatagtccacatacaaagtaatgtccacatatattttgtcttttagattttaacaaaatatcttttagatttcaacaaaatatcatttcgatttcaacaaaatatcttttagatttcaacactaaccacttaaataaaaaaaaggctttatgtaaatttatcttaacctgatgcatatattacgacccaaatgtgaatagagtcttctaatcacagaaaaccgtaattacttctttcgcaaacagtctggaatagaacccattaacccaacttggcccatatggtgggcccccatacccagcgagaagatatcctcatcttcacacgatcagcagatataaaacaatcctttaggaaatcgtctctcttcttccctagattcctctcaatatctaatcatactccctttaaaattccatggactatattgctcttattcttttttgatattatattctaatcataaattaactaaattaattattattattaattaatcatattacatggcacttcaattttgtgtaacttggccctaaaacttctaatgctattgtaaaactctcatattaattattaataatgtataatgctatattagtagacaattgcaagttaataaattatttttgaatgaatagaaaatataaaattatcctaaaattataccatgacactcacataagaaaattgtaaagagtattctcgcgtacataagtacaaacatgcaattttagaaaatattaggatatttaaatgcattaagatataagtggaggtatatgagtgtaactttcgtaagttgtaaggtatttatgtttaattaagccaataaaaaattgaagcatttgttaaccacaagcaatagtatgtgatccctttgaaaaataatattcatcgtataatatgaggcgaatgtcttagcttatatatatagtaaagaagatgtggaaaattttaagcatcatattttgaataagtctcaagattatgaattataaataaaattatatactttgcttagaattatgctccctctaaaagaggaagttatagaaaatctttctatggtctatattacccctatttttaaatattatattttaatcctaactaactaaattaattattattgttaattaatcacattatatgccacttcaagtttgtctaacttagtccctaaaaattctaatgctattgtaaaactctcacattaattattagtaatgtttaataatatattaatagataattgcatgttaataaattataaatggaaagagtagaaaatatagaattatcgtaaaattataatattatattcatataggaaaattacaaatagtattcctacgtatagaaggtacagtcatataattttaaaaaatattaggatatttaagtgcagcaagatacaagtagaggtatgtaattaaaacttttataaactgtaaggtatttaatttaattaagccaagaaagatttaaagcatttgttaatcacaagcaatagtatgtgatttttttgataaataatatacatcatataatatgaggccagattgttagcttatatttatatactagaggaaatgtgaaaaaattaaagcatcacattttgaataatcttaagattttaaattatttctgaattcatatactttgcttagaaagctttagaaaaggctttcgaaggactaatacaaactgttggacatcatataaatgttggacaaataaaatccatgatattggattgcaataatcggggttatgtaaaaaatatttgggtgtcatatgagataatgctcatacataatataacattataatctattatttgagatattgatgaatttttaacataaaaatttacgtcaagatatatgcttaagatttaggagagctgagagtggagagatttgagatatgaattgtggcttttatgacttgtgctttagttttggtttccaaacacgcccaataccaagcccacaatcaaattaaaaatgactcgattttgttataccagccaatattttcgataatgatcgatatgagaaaaaatccccaaataaaagaaaacaatataaaactataaatattatcaagataaagtatttaacctttcatattagtcgatatagcaatatatcgactgctatttcatatattgcctataagagcaatatttaaagataatttagatatcatttccttgattttaaatctccaataattctacattattctcttaaaattttaaaattgcttataatttagggactaatatttaattataaaacaattgagggacaaatatgtaaatagctaaatttaaaagaatagttaattttttaaaaacactctcaattatggggaatgtctcaaaaaaaccacccaactaatttaatttgatagagcccccctaactatagaggtgttgtagataacccctctcaactttggtacgattttagagaacactcttcgacttagtgtgtcttataaaaactcttctggctttttacatatctcttaacaaacccccataatgtaaaagagtttaatatgtgattttatcaaaataccatgttgaagaaagctattttagttaaaaagaaactcttaaccgataataaaatgattacgactaatttacaattctttttacctctaaatctttactttttcttttatctagcaaaaaacaagctaattattttatggttgagggatattttggcattttcaagtcaagtacttatcacataatgaattcgactcaatgatattagttttaaggggttaattgagaaaaattcataggattaaatcaaaattttgaagttgagatagattaactacaacaccctaaatttgacgaacaaagatttactcattttaagtagttggggggcattttttaacattttccccatagttgaggggaagttttctaaaattaacccttaaacaaagaataattttacctcgaggcttttggagattctcaactggtagttaatcaaatacgaggggagtatgaagtcagaaattgagacctgattccataccaccaggtggccatcgagatgacaagctcgtttgaagaattttttatcgagtacgttccgcgtctccaaaatgcatatgcagacgcattggctcaaaattttgaagttgagatagattaactacaacaccctaaatttgacgaacaaagatttactcattttaagtagttggggggcattttttaacattttccccatagttgaggggaagttttctaaaattaacccttaaacaaagaataatttaagatacatgtgacatcaatcttataagagtggattttataacgtctatcagtatctctaaaaatattttgttacaaaattcgcagagagaaatttaatatttatttgtgatggttatgtgatctttatggttctccttatcttttatgatttgtaataaattatttaataaaataaattaaattgttcattttatatgtcacacctttatgaatcatatagttttgatatgagtattattagtttcttttaactctttaacctaaatttttggacattattcaatattggatagatctaaattattttgttaaaatacaatccatatgtgtacaaaatatgtttaaatcattctcatattatactttatagttttttgaaattagagagtaatcattttgacaaattaattaattagttaagaagatgtaggaagattataatatcagattttagaattgatcacataatttatattttctttcttgattgaatttgcacatcctaactttgaaaaatctagaaaaatgtttttgaatatctataatactcggtcgccagataatataaagtggaagtaagcaatagatacgagggatttctttataattaaacaaaatcctctatgaccagataaacctactattttacgttgatgaattcaaactttattttttttattaataataatagttttttagatattgctgcttacatcattaatttttaaaattagaattccaaataattaaatttctcttggatcattaatattttaagactttaaacctcactaattatatggaaggtaaagtgttaaaaccaacaagattttatatattaaaatatcttaaactttttaatatattatgataatcataaactttttgcaactatgttatagtaaatacataaactaaaaatcaacaattataatatttgatcacatgcattgcacgtgcattccacctagtactattataaaagtgggttgccatgttaaaacatttattcccaaaatgccctccaaaacacatgcatacattaataaaacacatacttacatcctccacaatacatgcatacttaggtacaacacatatatacataaacatacatgcatgcttaaataaaaaataattatttttaataattattttattaatagttttcttaattaaatacctttattctctgcatttaatatcttaaatgacctcctccatccactctctccactatttcacaagtcttttcaattcatactattactgttatttttatacatgaaaagtaaaatgtaactgttatttttacatgaaagtaggagttgaagaggggttcattagtagtatagttggtaacctcaagaagaattcagtgatccaattaatgataaaaaaactccttcaacaacgtctattttatttaagagctatataaccccctctccatcccccaacactcacagcaaggctcactcaagattataactaaaatgagtaagtaattttcttctctacctccttgctattcattctcctttgctcggacaatgcaaataggaaattagaagtgaaactatttttatagttaccaactaaatttattaagtagctttccttagtggccaaacttgacagtagtggtggcggctttggtgaaggtggtgccgatggaagaatagatggaaggtcttggttagatggtggcgccggaggtaatgattgaaggaggcagagaagatgggtgaggagagacaccggtggagcaggcaatggagatagggtctgttgtgggggcaatggaggtggtggtggtcaagggggaagggtcgctgccggtgcccatcatatggtcgtgcatgtatgaatgtatgaatattattcaatttaaggttaaatatgatgtgtttgtttgttgttgtattgatagaaagttgctcaattattaggttgcaattaaacaaatattgtgattgttttgctttgtttcttttcatgtatggttaagttgatgagcatccaatattaagttaggtggacattgacatacaagggctgttgtggatttgtactgcatcaattcaatggattatttaatagtgaatataaaataaatgaattattaggactattaatatatttgttaatattttaaattttaataatattattagaaaatagtactaaatagtttacaatacaaattaaaaattgaaaaaattataggctttttacgacattagttccttaaatctttgatattctgaaactaatccctcagttccttaaatctttgatattctgaagtacctcaaatcaaaaatttaatatcaagtccctcccctaacctattttgaattagtccctcaaagtattgaaattgctattatgcttctcaattaataagttaatttgaaattaggaacaagtggccaagctcctttgagagtttgtaataaacttgagatttcttcaattttaatttaaatttcactatgcactttctatatgtatcatctctctattgttatcttatttatatattagtactatattattagaacaattaattaatgtcaaatttaagattagttatcaattagaaataaattgaatagttaggggtataataggatttgagttaaatactaattaaaatagtacatttttattatttaaaattatatttattttacagatatgtgtaatatttaatatatcactataaatttaaaaattagaacataaaacaagtacaaatggctacgtgtaacgcacatgcactatactagttctactaaaagtttaactgttatttttttctctcacaatgtctttaggacaaattttaaaaatcatccaatttacaaaaaaatcgcaaaaaatgacctcttctaaaaataactgtcaaaaccgacctagtttcagccatcgggttgaaactgggtcggttctgacgaaaaaaactatgaaacttcatgggacttgaagtcccgtgaagttcagcagcccataatgatgttaatctattaacattaggcggtgctaaacttcacaggacttcaagtcccgtgaagtttcatagtttttttttagtcaaaactaactttcagcctgatggctgaaactaagtcggttttgacaattatttttagaagtggttgttttttgagatttttatgtaaatcggatggttttcaaaatttctccatgtcttaattatttttaagaattaaagtcttcatcatttttaaggtcggcaacgatcgaggatgaggcagttaacggtggcgacttgcaatttgaatcaatgggcgatggatttcgatgacgatatgaagaacatcaaggaatcaatttttagggcaaaaaagcaaggggctgtgattagaataggaccggagcttgagatcactggctatggttgtgaagatcatttcctggagcaagatactgtagttcattcgtaagtggttcttctcttggaaaaagtgttatttttttataaaaatattttttgttttttcggttatttacgttgatttaagtctaagcttagcttcagtttgtaaactgaaaattcaagtggggttttaaaccctttgtattttctgctagcaaggaggatgcttggaagacaaatttcaattatttgctgatgtttgttgcctttgtatgctattaattatatgcattaggcttatttatatacatgtatttgactgattcaaatgtgttgtataattaacttaactatagggccgtgatgatatcatggtaaaagctcggaagtcatactatgaaactttgggagagggtaactgatcgagcgtagactaagaaaagagataagtgtatttgaaaatcaattttattttatgtccgagaggtctatggagcatatacatattttgatatggttgatggagagatatagagaaaagagaaatgatctatatatgatttttatagttatagaaaaagcttatgatagagtgtctagagaggtaatgtgatgagttttagaaaaaaaacatgtatttgtatatattgtgatatgattaaagatatatatgatagggtaacaactagagtaagaattactgaaggagagactaaatcgtttcctattactcagtaagaccccgtagattttgatcatgtttatgtgcatcagtaatgggtttgagtgtgcaaatttcattatatgcagcagaaccatcatatgcagtttttagtccatgagtcgacccatgattttcatgagtcgactcacgaaattgagtcctgttgccttttgtttctgctgagtcgactcattatgttacgagtcgacccaggaagtcatgagtcgacccatgactgtgatgagtcgactcattgaggattttccaattttctcagttcgggtttgatgggtttcgggtcgggttttatccacttatatatatactcccctacccgaaatcacctcatttccatcagtttccccagaaaccctagtccccctctctcctctctaaaaccctaggtgttcttggagattttggggcgtttcgaaggctttctcagcggctttgtgaggatttcagagaagggatctgttcttcatcatttctcaggcgagtaacatctcgccaaacccctctcccacgtttttaatagtttacaatggttttccatgagttttattgagcccaagacttattttcaagtataaaacaatgttcttgttagggtagatgctaaaaatcatgtgtttcggattttaaacccccacccacgaatttttgaagaaaaacccagatctggaaatatttctaagaaataaaaacatgagttttctttttgatcaaatgccctttttcatgtttaggggtaaattgttagatttaacacataagtaaatgttccttatgctatatgtgaatttatctctgtatcatagtctagaattgatggttataaagatgtagattagtgaattagagggaagaatcgtgttggtgaatttaacttgtattatatgcagatttcagcccgtaggtcgactcacgactcatcacgagtcgactcatcatgttgagtcgactcatgactgtcatgagtcgactcacgaagtcttgttgtgttgcatgttgtttctgctgggtcgactcgtcagtatacgaatcgactcataagccatgagttgactcatgactgtcatgagtcgactcacagagtccttttctgatatcaaatgtgttctgttgagtcgactcatatttgagtacgagtcgactcatcatagtattttctttctgtttcgttcatgcttctgttcaatttacatgttgggtgtatataagtatttatgcatacggtgattatgaattcacctgttcatgtgagatgatactttgaacacgagtttaagtcagtacagcagagtatgtacgggaatatagacatgtatacttttggtacacagtcctcgtgttggactataatccattaaagtcctcgtgttggactataatccatagaagtcctcgtgttggactataatccatagaagtcctcgtgttggaccataatccatttcaatcatgtattagacttttgctaaacttgagcacgttattcaataaagttggatatacgacacattgtatttggccgggacatgatagctacctaggttgatcatggcacctattgtagccttgtttcacttacatgttattggtagagatgggcatgttttccttttccttatttttctcttgtaactagcttcgggttttgtacttagggatctacaatttgagatacaaggtatatacatgagggtttccttgtttggattatttcgctcgacgtacctatgctcgtgttgtatttccctaagtactaagacccgttaatgtttgtataaatgatttatattacattgtattaactgtattttcatatacaacgagccctatcccttggggttggttgtgatgttgctcgctagcgctttgacgctcgttgtccctcccccctttcaggtaacgagacaggagcccggagggccgcaggttgaggacgacccttgctagtgtcttttgatcctctcattagatgtattttattttctttctccacttgagatattttaggctagagaggtatatgctctagagttgtaaaggctgtgtgccttattttcctgtatcagtcattatgtattttgaggcatgtgagatctccagattgtcatttcttttcacttcagacttgtctatgcatttcagtttattgtgttgatgagatgtgttaaattgatgttctatcattgtaccaagtttctgctataaaaccttttacttgcctatacctacatctgttgttgactccactagagagatagtgattgtgatggtgaaacatgttattgcacggtgtggtgcatggcaggtttgacattccctggtttacctcggactgcagccttgtgtgaacccaggggcgtcacagttggtatcagagctctagttccagaatccctaggatcatcctgtgttgagtcgtggagctaggttagagtttcctaggattcatgagtagagtccgctaaggatttcctagtatgagtgaggacgatttatgcgtatatctcaaaattttgagaatattttttttggcaactattttgcttaaagtatatgcttgaatattatgtgatgtgaaaatcatattgagatgaactatatatatacgtctactttgactcatgaaccttatttttcttatgatcagagagatggcaggacgtgggagaccccgcactagaaggtccgctcaggcagagccccagcaggtcccacctgagccgcagccggctccacccgagcaggagcaggcaccaccagagccgcagcaggctccccagtatttggtggatatcatggctccccttattgccaggatgatagccatagaggagttggtaactactcacatagcacctcggacgccaccaccgcccgtagctcagcagcaggggataccagccgtcctgatcagagagagagacccagaggcagcacctgtagttattccactagcagtgccagatagagccacggagcaggaagcttggttccgtatggtagagagataccagaggatgagggcaccagagtttcaagggtcaccagaccctcttgcagcccataagtggaaggaggatgtgaacaatatcctcgatatactcagtgtggacccggtacagaagcagagattggcatcttatagcctgaagggagatgccgggagatggtaccggctacagtttactccagagcagaggatgaccctcacatgggaggatttcatttacttcttcgatgggcagtatatttcttctgcagcacggactgggaaggagcttgagttgtcccggatgactcagggggacatgacagtggcggattatgagagccggtttatggagttgctgcatttcacgggtatgtggcagacaggagagcgtcaggctcagatgttcttggctgggcttcgccctaatctctgacggtatcttgtgtcgaggagattcttttcagtcagggaggtagatgaggctaccacttctcaggagatcgagaccactatgttcctgaaggacaaggaggggaaggccaaggcagggcagagcggggaaaagggcaagaacaagagacctttgtcagcatcagcatcagcagcagtagggccctcataagaagggaccccagcaggatcagcgagcgcatcagcagcgcaagttccagggttcttgtttcaactgccacaaagtcgggcacaaggcatcagagtgtcgtagtgcaccagcaggagctcagcagggcaagggcccgaaccagcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgatgaaccgggtttttcgtcccttcttagatcagtttgtgatcgtcttcatcgatgatatactcatttactcgagatcggagacggagcacgaggagcatctacggatagcgttgaggactcttcaggagcaccagttatatgccaagttcagcaagtgtgaattttggctttcagaagtcagatttcttggccacgtcatcagtagagagggcatagcggtggaccaggctaaggtcacagcagttcttgattgggagcccccgaagacggtgacagagattcgcagctttttgggcttagctggatactacgggaagttcattcaggacttctcgaagattgcgacgccgattacacaccttacgaagaagggtgtacagtttatatggagtatggagtgccagcaggcattcgatattttgaagactaaattgactacggcgccagttctgactatcccgaccagtgacaggacattcgttatctatacagatgcatcgttggcaggcttaggaggtgtattgatgcagactcagagggtagtagcctatatctctcgacagttgagggtgcatgagcagaactatcccactcatgacttggagttagcagcggtggtgtttgcattgaagtcatggaggcactacttatatggagtgcagtttgagttattcacagaccatcagagtctgaagtacctcttttctcagaaggaactcaatcagaggcagaggaggtggattgagtttatcaaggactacgagttcgcgattcagtatcatccagggaaggcgaacgtcgtagcagatgctttgagtaggaagcgtcgacatcgggttgcggctttgagatgttcattgttcagagaccttatcactcttagtcagtttgattttagacccgaggttagaggaaccagtgcatttttgggagctgtgtcagtgcagccatcttggagtgacagagttgtcagagctcagtcgggaaactctttgatcaaatccgaaaggaggagatttccaaggagcctaaggctgattggaccattggagcagatggaggcctacggatgaagggtaggttggttatgccagctagtgcagaactgaagagggaattatttgatgaggcgtaccgtactcggtacacagtacatccagggaccataaagatgtacaaggacctgaagagacatttctggtggagcggcatgcgtagagaggttgcagactatgtggctagatgtttcacctgtcagcaggtgaaggcagagcatcagagaccggcagggacacttcagcccttgcctattccggagtggaagggggcggatatttctatgggcttcatagtgggattgccgaagtcaaagaaggggaatgattcggtttgggtgatagtggatcggttgacgaagtcagcatattttatcccagtgaggactacttatacagccgagacttatgcgaggatcttctttcgggagatagttagacttcacggagtgccagatacgatcatatcagatcggggatcggttttcacttcgcacttttggaggagtttccaggaatcatttggcagcaagctatcttatagtagtgttttccacccacagacagatggtcagacagagagggtgaatcaggtgttggaggacatgttgtgggcatgtgtcattgacttccaaggcagttgggaggatcatattccactagcagagttcgcttataacaacagttatcaagcgacgatcggtatggccccgtatgaagcattgtatgggagaccttgtagatcaccgatatgttgggccgagccggaggacagcttgatgcttgggccagagctagtgaggcagactactgagaaggtagctttgatcagagagcggattctagccgctcagagtcggcagaagagctatgcagataagaggcgaagacccctagaatttcagattagggatcaggttatgctgaaggtatcgcctatgaaaggcgtacagcgattcgggaggcgagggaagcttgcaccgagatatattggacctttccggattttggagtgcattggagctgtatcatacagactagatcttccagcttctatgtctagtatacacaatgtattccacatttctatgctcaagaaacacttgcacgatgaggagcggcaacgagtgttggatgcaccggagatcgagcttagggatgatttgtcgactattgagattccagtggccatacttgctagagaagacaagagactcaggaacaaggtgattccattggtaaaagttcaatggaaccgaagtggagtagaggaagcttcttgggagcgcaaggaggacatgcaacgcgactacccacacttgttcgagcaggtaaaaccgatatgacttcttacttgaataattatattatgttttgatacttatatttaacactagaatgagggtacttttacttaattcttaatctttcggaacacgtggtatatacatggggggttccttgtttggatttttcgcccgatgtactagttccactagattaggatttgagcgagaatattatcattttagatctgcatcagtaatgggtttgagtgtgcaaatttcattatatgcagcagaaccatcatatgcagttttttagtccatgagtcgacccatgattttcatgagtcgactcacgaaatcgagtcctgttgccttttgtttctgctgagtcgactcattatgttacgagtcgacccaggaagtcatgagtcgacccatgactgtgatgagtcgactcattgaggattttctagttttctcagttcgggtttgatgggtttcgggttggattttatccacttatatatatactcccctacccgaaatcacgtcatttccatcagtttccccaaaaaccctagtccccctctctcctctctaaaaccctaggtgttcttggagattttggggcgttttgaaggctttctcagcggctttgtgaggattccagagaagggatctgttcttcatcatttctcaggcgagtaacatctcgccaaacccctctcccatgtttttaatagtttacaatggttttccatgagttttattgagcccaagacttattttcaagtataaaacaatgttcttgttagggtagatgctaaaaatcatgtgtttcggattttaaacctccacccacgaatttttgaagaaaaacccagatctggaaatatttctaagaaataaaaacatgagttttctttttgatcaaatgccctttttcatgcttaggggtaaattgttagatttaacacataagtaaatgttccttatgctatatgtgaatttatctctgtatcatagtctagaattgatggttataaagatgtagattagtgaattagagggaagaatcgtgttggtgaatttaacttgtattatatgcagatttcagcccgtaggtcgactcacgactcatcacgagtcgactcatcatgttgagtcgactcatgactgtcatgagtcgactcacgaagtcttgttgtgttgcatgttgtttctgctgggtcgactcgtcagtatacgaatcgacccataagccatgagtcgacccatgactgtcatgagtcgactcacagagtccttttctgatatcaaatgtgttctgttgagtcgactcatatttgagtacgagtcgactcatcatagtattttctttctgtttcgttcatgcttctgtttaaattacatgttgggtgtatataagtatttatgcatacggtgattatgaattcacctgttcatgtgagatgatactttgaacacgagtttaagtcagtacagcagagtatgtacgggaatataaacatgtatactttttggtacgcagtcctcgtgttggactataatccatagaagtcctcatgttggactataatccatagaagtcctcgtgttggactataatccatagaagtcctcgtgttggacgataatccatttcaatcatgtgttagacttttgctaaaccttgagcacgttattcaataaagttggatatacgacacattgtatttggccgggacatgatagctacctaggttgatcatggcacctattgtagccttgtttcacttacatgttattggtagagatgggcatgttttccttttccttatttttctcttgtaactagcttcgggttttgtacttagggatctacaatttgagatacaaggtatatacatgagggtttccttgtttggattatttcgctcgacgtacctatgctcgtgttgtatttccctaagtaccaagacccgttaatgtttgcataaatgatttatattgcattgtattaactgtattttcatatacaacgagccctatcccttggggttggttgtgatgttgctcgctagcgctttgacgctcgttgtccctcccccctttcatgtaacgagccaggagcccggatggccgcaggttgaggacgacccttgctagtgtcttttgatcctctcattagatgtattttattttctttctccacttaagatattttaggctagagaggtatatgctctagagttgtaaaggctgtgtgccttattttcctgtatcaatcattatgtattttgaggcatgtgagatctccagattgtcatttcttttcacttcagacttgtctatgcatttcagtttattgtgctgatgagatgtgttaaattgatgttctatcattgtaccaagtttctgctataaaaccttttacttgccttgtacctacatctgttgttgactccactagagagatagtgattgtgacggtgaaacatgttattgcacggtgtggtgcatggcaggtttgacattcctggtttcacctcggactgtagccttgtgtgaacctaggggcgtcacatactctatgtttacaccaaaggtcaatcataagtccttatatttttgcattagttattgatcaacttactaggcacattcaggataaaatttcatagtgtatgttatttacagatgatatagtgttacttaacaaaactagaagatgtataatttctaaagtagaaaggtagatacaagctcttgaatctaaaggttttagaaatagtagaaaaaaacagaatatattgagtctatttttactaaaactaaggaaaaagagcctatagtacatattgatggttaaaaaatatttaaaagtaatcatttttgctatttaggatcagccattcagcataatagtgagattgaggatgatgttgcccatcaaatcaaatcaggatggttgaaatggaggagtgcttcaagagttttgtgtgatcgtagaatatcaatgaaactagagagaaaattatacagaacggttaaaagaccaacaatgcttttatggatcaagtgttaggctattaaaaaatatgtgcaaaaaataagtatagcaataatgagaatgttgcaatggtcttgtagatatacactgaaagataagataagaaatgagtgcatccgtataaaattagaggttgctgctattaaggataaaatgagagagaattgactgaaatgttttggtcatgatctcttatgcaccagttatcaaaatactatcatgttaatgattacctctgatagtcacttcctcccaattccatcgccaatcatcttcaataagatgacgagaccacaaaactatcatgttaatgattacctttaatagtcagttcctccaaattccaccaccaattctctccaataggatgacgggtccacaaaactatcatattaatgattacctctgatagtcaatcctaacccccattgaaaatacttcatcaagtagtgttctaccatgcgatgaacacctacttatctctcgatcaagatagtgatctaccatgcaatgattcactatctggtcttctccgaacgttctatctccttagaatgatcaaaaatagtgacataccatgcgatgtgttactattccaatcacagtcgttatactctcatgtcactgaacggcttgatttccctcgccaagtagtattctaccatgctatgagcacctacttgtctctcggtcaagatagtgatctaccatgcgatgatgtgccgctattttaatcatagtagttatacattcatgtcactgaacgacttgattacctccacaatgtcatgatgttattcgttgatagtggcctaccaaacaatgagcctctatcatcccccttgtttccaaatagtgacctaccatgcgatgagtcactattcatcaacgataccacatcatcccagcaggcctaccatatgatgagcctcgttttcagaataccatgttgagttgttatactgaatgacacaaccaaactctaacacttaatctaatgccttgaacgcttaaggatagagaagaaatcttagcattaagcctaaaagaaactcatcgacaacttaccatgctaagggcaaaagcatggctagtccaactcaaacggccattgataaagatacgtcaagtctgttgatagctgaggatttgctaaaaatcctagatggcgatcattaactgcgtttggagagttcaactttaccagaatggacaagttcgctggaaggctcctcatttcatctgaatagtgctcattttgcaggccttaagatctaaagtatttcaaaccttatgcaacctgatttgggtctgaaaactttagaggaggttttataggcaataaaaattaccttaattcctagcaaagaagctcaaaattgacaaaaaacgctaatatatctcaaaccataaggaaattagtgaaatatacaggagcaaaccgaaccctttggggttggtttggtcggctccgtctcgtcgagatagtcaattttcatatataattcatccaattctgacttacggtttgaaagttatgacccgttcttcacagcatgttctgaagtccgcatgtaagactagacttcgcatgaacattaaagtttgtcgcagtactaagtccgcctgcaagactggacttctcctgaacattgaagttcgcctgcaatgctaagtatgcctgacaacttagctcgcctgaaccgattgaagctcgcctgacagcttcgcctacgaggttcgccatgcagcgaggctcaacatcaaaagacgaggttcaccacgtagcgaggctctacatcaaagttcatcactatggacaaagctactttggaagatgaagctcatcattagaaacgaggtttgaagctcgtcattggaaacgaggtttgaagctcgtcattggaaacgaggtttgaagctcgtcattggaaacgaggttcaaagacttgtcattggatacgaggttcgggactcatcaccagacgtaaagctcattagtgaagatgaggctcgtcaaaaggaaattcacaagacttgctatgtagttggactcagctatcgtagacgaagttcgttggtgaatacgaagctcgtcagatgatgtcagtgaaaatagagttcgctatactacaaagtgggtcttagaagacgaacctcgctacatattgaggctcgtacaatcagatgaacctcaccatacagtgaggctcttcatccacaagagatccagctgtaacaactccgaagacctagtcagcaatgtgggctaaatccaatgagttagttatgccacggctccacgatttcagcgcatcagttacgccctctacccataattttagcacatcggttacgtgctgaaactctataaatagccgcaatcaactataaagaggggacttttggagggacagacgggaggcagagctttggcattcaagattgaaattcgaaccttggttctaacaatctaagccatcaacaaagtctgattctcctctcgagttgaagcgatcttgatctgattgtcaacaggaagtaatctcagcttgagcatcgagagaagcatcctttcactaccaagaacccatgttaaacaaagtggagctaaattaatattctcttcatctgtaatcgagagagtgagtgattgtacgagatttgtactaagtgatcgaacccatttcttaaaacaagagaatcaatcaaacatcaacttttcgaccctacatctacaactacattagtcgccaatacacaacatattgagttcaatgttatggcatatgtatagagcataaacatgaaatacatataaaagaagcatcactcagcatcacctcaatgttttaagtgaaatcttcctataacctcgaaccataatcacgatcgtgaaagcagatggactgttttaaaaaggtgaagccatagagatatgataaatggaactataagttgaacaaacacccgcacaaatagtcacagcagagcacatcgcaatcaaaagcccagacagcaaaagggtatctctattcatatgggtctccaatctactccacttcaacagaactcccgagctgttgagcataaccttcgtctctctccctgcataaaccatttcactttatgttcaactggaatgataaatctagcgtgtcgataaatcaaacatcaaggtaatctctcctgataatgcaaatttatatttaacaaatgaaatgtgctcatgattttcaagctaagttattacgcagtagaattgagggtcaataatctcccctttcatggttaatctatcttttttgttttcaagctttctctaatcaaaagccaaacaaaaatctagactttcaaacgaacatgaaatttccataaatccacatatacatatataatcctaccatcaagcaaaaactgatagtataatttaactgaaacaacaaggtaatctctctcctgttgtgacggagttggcgagggcatggaggaagagtcggcggcggcggacggtgaaggagaaatgacccaaaccctaactccccgtcacggcggaatcggcaagggcatgaaggaggagtcggcaggggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggctctagagagagggggagagagagattgagattaagaggagagagagagagagatcacgattgaatatttggagagagagagagagatcatgattgaatatttggagagagaggggggagagagacttctagcttattcttttttttttaatatgggttttttttgtaaaagtacatcactttttcttcattccctcattgttagatgaatggccaagattaatacacttcactaccaagtttttttaaaaaaatatatatatatatatatatattatataccctttaaaagagggagttccaaaaaaactttacctaccccaaattacccatcaacaaatgtaaatataccaaagttatccattataatcgttacgcagacttcatcatcatcatcagaaatcaaaagccataaacttaccgtaggttacgccttccctccgacaatcagttcatcggttacgcttctcctcagccaacgccctcccacgatcttaagtcatcaaatgccaaagatgagtattatcgtcctcatcatcaacgcaccgcctctgttatcatctcaccagttctcagatttttggcatcggctaggatcaagaaggtctcttcttcttcttcactccgctaatttaaacttatgaaagagaaatgtgatcttttttgtttttgttttgtttttgttttgtttggttgaagtttgacactctagaattcaattgtttttacaataaacccatttggtacctgattccaatatttccagtcctacgctactcgaagatttattttaatcttatgaaagagaaatgtgatttttttgttttgttttgtttttgtttttgtctagttgaagtttgatactctagaacttaattgttttacaatagatccatttggtaccagattccaatatttccagtcctacactattcaaactacagaattactgatttgaattacctaaaagagctaccctgagccctattggtatcaagatcttaaacttgtttgaaatagcataagatgtcatctgattattaacatactaaaaccacatttaccagactgcttttacgttaatttgtttttaagttgttcaaatgaagaaattacattctgtttagtgtgattactgaaactatgtgattactaaaactgtattttgtttggcattgtcaggtccggatgaaggtctgttgtgtattggaatcaattttgaggaaaaaggataatgagcatttatccattatagcatcttattttagtgagaggagagaatctgtggttaaatactctgacgtacctcaagtttctttgagagaaaaggcaaacaaagtaagtagcctcattttccttttcgtcccctttgaaatgatgtccaaagttattcttgaatcttgctatattcaatatgtcttactttttgctcctcaggagtgctttttcttgtgcatttctacctatttccttggatttcctgtatttgtaccttagtattttcatatcatatcctttttaatatattcaaggtttaatgtgaaaaatggttatttcttgtatattcacattcaatgatctaacactttgaatatgatttaatcaaaatccaacccattttcaagttgatgggaaaattagagccattgtactgtatcagattttaaaatgatatttattttctacatttcactttcggtcagcagttttcttctattgcgctcatattctctctctgggtgccacaaggagtacagaaccggtgaatgggataattgcttgtgtttatgtctcaatattttagctttctcttacccttcacatttatttgatggtattctgtatagcagccaacccctggatataggtgatgcaccaggcaatcaggattgatgctgcttatctataggaatagtatggaaaacacatttttctgttgtgcccgttatagataaatatgacgttctattggaccatttacggttcttgggtttactagaatctgtttttagtttttattttaagttataatctaataaaatctacattcaaagcccaaagcatccaagacttattaatataggcacacaaacaactaaaatcttatcctctgaatcgatcgtttatggtttttcatcttttcccttgtttacctttttataatagttcatatttgcctatttatatttgtttgtttcattatcttttttctcttaactttcctgatcaaattccagctcattttttgttttctcactttttgtatgttactgatcagtttaatgccttcttttctttaggttttaagtcttttggatggggacaagatttttggaacagggaaccaggtggagcaatctaacacaagacccatgccagttccagctgttcagatgcccgacttaatcgatacaagtgatgcaaatgattatggaactgaatctttaacacagaagcatgttgaccaaaatattggaaacctgacaacatctggttctttggttgatgatttgtttggagatggccctgttgctggtctgaatagtagtgaaaatagaagtaaagatgatccattcgcagacgtatctttccatgtgaccgaagagaaacaacttgatgacatattttcaaggttgacagttgatgttaacaaatctgagaatgagcagaaagttaataaagagtttggattacttgacgctttcagttctaactctgatcttcttctacaagaatcagaaacgaaaacaagcaatgaccatgacttgatgactggtttgtctcttaacagtaatgtgctagagaagaaccaaccttttattagaacttcctttgttgataccataaatctgtccagccaaatgcctacgaaccaatccagccagggtactgtgagcagtgctctaaatggaggtcttggttcaaactccctattccctatggctgcaatacagtataatatgccccaaactatgatgttcaatccatcttatactaaccagccaatgaactatgccgccataggggcgttcattgcacagcagcaactactgtttcaaaatgtaggaaatattaatgctggttatgggcatgctgttgacggaagtcactcagcattacctgacatttttcaactttcaaaaaatccggtacaaaaccatgctacaactctaactagctcgaaggaggatacaaaagcgttcgattttattttggtgagttcattcttcctttacccagataaataaattctatttcctattgatttcctccttctgaaactatcttctacaataaaaaaggatcatgctaataaacgtattagaactgctggattgtgagatgaaaagttgtatgaatttcactaggagaaagtactagaactgctggatgttgagacgaaaagttgtatgaattagtccaatagctgtcacacagtttttttgttcaattgcactttttatgcatataaattgtctgtatactgtatttttttaattaagagaataatccatacacgattctacaacatagcttccatgttagtcttaaaaaactgtgtgcaagatcccagctgtatacaagatgaaacgtcgtagtattttgggccaagcagtgtaagtcattttccgagcattgactgcattgtgcatgatcccagctgtcatcttaatggtcttgcgcaatgaggaaattaaggttgttgataacagatacgtcatttatgctagctacagatcatctacagcttttgtgttagctaaaactataggtactaatttatagcataacgttttataactgtatattgataagtcctttttttcggtaggtacttggtgctgggtgctggagttgccggatgttactctattctcggtattgctcttgccttctgtagtccaagaaatcgattcctccatgcttttgatattatctttacttcttattctttttcccctcatcttttgaattttcttagctattagaaaaattattttaagggtagccttggcgcaacagtaaaagatgtattatggaaacataaactatgattaatatcttaaaccttagcaacatcatatgaaggtaatacatgaactatgattaatatcttaaaccttggcaacttcatataaaggtaatacatgaaagtttgatttacacatatataaaataattattttaagatgagttaactattgaagtcctatacaaagatgttaatatatggagcattgtcaacctatagaaatgtattggacctactgctgttacattggttatagagttaaaagaacacttgatagaaaccttttatatctctgaagatgcttgttttatgttaagggtgtaaaaattaccatttatgtaaagaggttttctgccagaaaaaaaattaaactatctttgcatgccattgttcacataacctctttacaaaaaacttctattagtgattggacttgccttctgatagtgctgttacttcatatgtttgattaactattagtttgaatcacttttcttttctacgtatttttaatctatcgaatgcaggcatattacatacaattgtatttaacagttaacacaacactgggacttgttcggccaaaatatgtagattgtgaaccttttgaaattacttatgtgattaattctccgccttcaatgtacatgatatataggtccttctggtgatcattccaataaaataaaacttgtgaacttgtagaagaaaactgaacaaaccaacgtaagacaaagtcttgttatcttcacaaatagttcggtaagcattttgattcacttcaattattattttttgtcatagggatgcttgaaaagttatgttgagcatccaacttcttgcaattatgatttttagttatgctgatcatcaatctttgtaggaatacttagataccttatgtattgtgtataactatcaatttttagttcttgctaaggagttattgcaatggacttgttacttaaatttcctagactttcttttatacatctcataactatcatttagagcttaaacaattacctcaagcaatatgtatttaatataaataaagtaattactgtcttaagaaagctgattagcatttcttgaattatatctaggttgcaattgattgacaaagagtgaaaagtgcaactgaaaaagctttcacgaggtccaaatccgttatcagtctttgatatggtagttcttttgcatttacattttttggtgaatttccattttccagtgtttattaattcaacacatgtttatccttatgcttgtaggaattctaacttaaaatgagactattgagctggaaaatcttttaatcaatgcatgcataaccatgaattcagttgaagctagaaaggagactagaaaagctcatgcctgtgaagaatttacagttagattcatttcccaataactttctaatttatttccttgacatttgagtttgtttcgttaacattatgtcgcatatgttatctcagaagagaccaagagagatgatgagaactggacgaaacacacgttagggttagtagtcattttctcctctatatttatttggattataattgtggtaaatcaaaatcgttcagtatattagacacttgctacactattatgcgcttcagactccactgggaactgttctgtagtatacacacctgcggactatttttgcgttcaagtcgtgaatatgctagaagtttcagaatatggggtttcttgcatgattgaagtctatgtgtaatgatattaccctgtctaatgcatgtgtttgtctatggtaaacaagggtagatgccatattaataggcagtacaatttgtcatcacattacttattaacgaattataaacataaaattctctttatttccatttcaacttatttgtttcatcacttcattactgttcttcttaattcgcagttattgggaacaggagttaggctagcatataaacatgttcatatgaatactctggacaatgaaattttaccgtcaacaacacgtttaaaatcagggtcacttgaatttttaaaattatctgatcactaaagcttataaagttcaaacagaaggaatagtagtttctcgtttcctcaaggataggagaatgtaacctataccagttcgagatgctaataccgctgaaccattgaactgcatttgaagttgaggaaattttgatcctgtgattaatacacatacttataacaaataagaaacagtttgcgttgcttctcctatttgcaatggacttgttatgatttttagtcatgctgatcatcaatctttgtaggaatattgtttggatcaacaaaccaagggtaaaaactacaacttctcgtaggttctatgatcaattagttaatttttttacattggccaaaaaatatctaacacatgatattgcctgtaaagtgcagttacataatatctggggtacgctgctagctaaaattttatctggcaggacataatgtaaacttctggttaatataataagtttcccttacgtattaaccttggaatcagcttactaaatttctgatataatcaagcatgagtatgatctatttttcttttatttgctaatgatacaaccgaagctcttttataattcaagaaattccatctctatgattggttgcttcctctttcaagaaattaacaacctgttgttgctttcaaatgttgtaaagtgcaattacataatatctggggcatgttgctgcctacacttctatttaacgaaacatattgtaacattttggttaatatagtatgatgtgattacctatcaaccatgaaatcagcttataagtgaaattctaatataaccaagcatgaatatgctctatttttcttttgttcgctaatgacacaagcaaagcacttttaattcaaacaacaaggttataccaatatgctccttgtaagtcttgataataaagactatttaggtaaaatttgagttgtatattcttttataaaaaaaagaaaatatcggatagttttcatgatcaggaattttggtatgttgatcaagggatgttaacaccagaaaccaatgaatcagcctctttcacaatgcagtttcaacgtcaagaggagaaacggtggctgcatgtaccccatgttcctgctggaggccttcaagagacctcaagaaagaaactacagtacaaacactaatgcacaaaccaaatcttgaagggcacaatggccattaacaacaatgctttagctaaactggaagtgctagggtcctttattgactcattacctaagatctgatctccgagacattacatactaacattatatttcataaattcgaaattgactttcattttaaactttagaatgcaagagaaagcgtatgtgatgtaatttacaaatactttacctctgactagttcacgcctgagtgcctcctatattgccttgagatctcctctgagcaccaagctctagagatatccaaacgtatagaggagtccctttatatatcacgttgaagaacaacaacaatgtctaaaaccaatgcagagaaaatggagttgttggctgatagagctgagagtctcttagtatgcctgaagcagagatttcctggcctaacacaaaccacattggacatgtgcaaaattcaattcaacaaggtttttgcttttgctcatctaatttctcacctttacataattcaattttccttgtaactaagacttgtacttccagaatattgggaaatcgattatagaaagttattccagagtcttggagagccttgcattcaacattgttgctcgaatcaatgatctcatatatgttgatgacttaagtaagcattctgatcagaaaaatgtcacggtcccttattcaatttcagactctatcactccttatgctactgcttacggaactccaagcttctcaccggtgccattgcttagcctagcttgtggagagaaaacatctttccgcatcagaaaaggtcataatcatggatttagtgtgaaagttttgtcagactatctaaattgcgaaacgagagggagaaatgatagcactattatcaacatttcagaatcgatcccaagaatgaacgagttatgattcatcgagctcatagtaagatcatcccataacatgtacatgacatttgtaataagcttgttttgtgtatgctgagatttagtcaaagataacaggttgcgtgtgtaatatcacccaatcaatcactaaatataattttattgttcaaataatgaatttttagcttctatatgtttcattcattgtttacattcaataatttaataacaaacctttccctaaataaaatttaaaataaataataaaaaaattaccacgtgcattgcacgtgcaatctaactagtatatatatataagggagttatgtgcaacttaccctttagttgattatatctttgcatttttattttttctacagtttttaaaatcatatattttgtttcaagtcaaattgaatctttgaagataagttatatagaagcctctcatcaataatcaattcctctaattaccaacttccataactttattgattgtaatacatctcagaagaaacttgttccattaatgaggttatgttacgtggatttacttactcataaagtaaatttcatgactacattagacaatagaataatgacacatgtaccgcctgatttgcttagacacttggcataaatattgctcctaccttaggtaaaggcctttacatccactcggtagcactaaacttgcttgatgaatcctattctctaaaccgcttttttttatctttgataactcaaagtttttttaacactttaataccacaaaaattataaatattttaactttgataccacaaatatttgcattttttacagtgataccttaaagtttacctattttagctttgcgactctaacccaagtttggggtatcaaagtgtcaaaagcaaacctttatatgccaaaattaaaaaagtataaaatttgtcatgacaaagtgtcagaaataaattatatggaattattgtagatttgaaggagtaatatggaatattgtagattatgggtatcaaagttcaaagaactatgggatattaaagtaaaatagggtgttttggtcattaagggattaatgagcaatttcaaagatttaaaggattaatatggagttactgtagattgagggactaatatggaattattctagatttaagggactaatatgtaatatctatctttatttgaggctaaggggttgtttggttgcacacttttataaaaaacttttctcaaaatgtttgacaatggcaattttgtaattaaaatttttctttagattttttgtaaactatatttggttaaaaaaatttacagaaatattttctataaaataccaaaaactacccaattttacagaaatagatttcctctcaaaatgggaggaaatcttacaccatccttttttaaatcacaaaaccccttcccgtacccatttccccacgtgctgatatttcttgagctgcttcgagggcagaaaatcttgctctcgttcgcgcatcaaatccagcgagcttttggtccttcgcgcccattaccgcttacaactcgttccctctcgtccatcgcccccagatctagggttctctcgttcccaaatctcgtgctagggtttcatctcattcccaaatctcgtgctagggtttctgatctcaaggctctcatggtaaattcctgttctttttgcttatttttttgtgttaatctatttgtagttgatctattaacaaaaaatggctctagggatcactgaaggattcttctttgtaatatacatgtaaataagattaggatagagcttccctttctttatcaatgtttcacaagtaactatcagatccaaaaataaaagagagaaaatttatgaaagatttaaatttcagtgatttgataaaagcggttttgcaaatttgctagttactctattcggttacttttttgtttcaacaatcaaagagaaaagtctacattattttcatagttggaggattattttcgtcgttggaggtagctaagcagcaaaggtgaagtctttgtgggtttcttttagtttacagataattttgggtttttgtttcattttgttgtgatgatgtttttctaaggatttaagagatttctgttgctttttgttttgttgttgttgtttttttttttttttttttttaattaaaattttattctctattttacaagcagaggccgttttgtttgcagtttgtttgtgcttcatttctcttcagtaataaaatcttatctattacatacataatagtcttttttttttttttttttgtcaatgaaaatttcattcatcttccaaatattgaaggttcagcacatcaacttcctcagtagactgagattacatgttaactaacagctactcacatcctcaagaaattacaaagtactaagccattctttgtcttccgccgagaaggagcaattgaggatattagatagaatgttgaactttatctccttaaacagttgaacagcagtttttccttcttgtctgaaaattctggagttcctttcacaccaaatactatagattgttgaggtgagggtcattttcttaattttttgcttgaaaccattccccctcagtctaaagcaataccagtttataatctgactccaaatgcaagatctccacctgaattatagccaattcataaccatgtcctaaacatcccttgagtagtgacattcaaaaaaaaagatggtccctgctctcagaaccagagcaccagcaacaattgttaacactcacaatccttcttttgatcagtctatcttgtgtgagcaaacgatcttgaactgctaaccaactgacaaaagaatgtctgggcagatttgaagttgcccaaactgcattgtaccacgacactacagaggcaggaggagatagagcagaatacagcacagagaactagatttttgaattcctgaaacagttttgaattagttgcatcagattgtcagcacttccatatattctcagagccttatctctgactttcaaaaataatttccacattcacgaatccctactctttgcttgaatatgccaaatatcattattctttaagtatgtgccatgtatccacttaatccaaagactttccttgttaacatgaatgagccaaagagttcttaaagttaaagccaaattccagatagaagcagaatatataccaagaccaccttgcttcctgctcaaacaagtcttatcccaagaaataagagaaattttatgaacatgctcggttttaccccacaggaagtatctgcacatttcatcaatcttttttagcaccttaacaggcagaacataatttgctttctgttgttttttgttaatgggtctgtgttcatcttatttggtcatagtatttgtatgtttcttgttttctggtcatatttgttaatgggtctatgtgttaatgggtctatttgtagctatctattaacgaaaaatcgtgctagggtttctgatctttttatgttcgtagttgatcaatttgtggatctagtttatttatagtaaaaatatattttttttatgatagttatggttaaaaattttgttgttacacaaattcataagatcaaattgtattttcatatgatagttatgattgaaaattttgttgttaaacgaattcataagatcaaattgtattttcatatgatagttattagatgacacttttgtagtttcattcctggttccaccacaattcttatgcttaggttttggcaatttgatcttaacaatggcctcatgtcttatttttgttgcataaactttaaagtttatagacatccacacattgacatttcaacttcttccatgtttgaaattattttgacactttgcacctataattgtaataaatagaagcaatcctcttcttgtcattgtgtaagtagtaaaaaatcatatccagtctgtattgcatatacttttaaagcctccttaagcacctggttgctaccaagtctcaaaccctttttcaattcaattagcttgttaaaatcagcgtcaaggttgaactcaggttgtgaacatcctcttcatcagattcatataagctttctaactcatttgtgttgcactcactctcaccagaatatctaggtaaatctttagagttctctcaagtttggtgtataaaagggttttgttaataagttagttgataactttttttatcattttttattgttgcaaaaacattttaaacttttttttgtaacaaatgtagatggatggtgtaaatgaagaacaaataaagagaatgtgtgctaatatgactatatcttccgtggttacaataataccttgtttattgagaattcgtgctaggcgcaaatccatttgttatgctccaagagaggataagatgaggaaaatttattatagaaatgctcacttcaagcgcatctttgaaggatatagtgatagttgtagctcttatattagaatgaggcctaaagcttttttcaaacttgtgggtgtaatgcgaaatcatggttttctaaaggacacaaaataccttcaagttgaagagcaactcgctatgtttctttgcataatgggtcataaaaccaaaaacagagtaataaggactgaattcataagatcgggtgaaactgttagtaggtactttaataagattctacaagctatgaatggtcttcgtgattgatacatgaagcaatcacctaatgaaattccaccggagattaccaacaatccaaactattttccttacttcaaggtaagagagaaataaattatttgagtaagtgattttcataatttaatgatatgagatactaataatttcaatcattatcgagttttgataggattgcattggtatgatggaacacatattgatgcaatgttaccctctaactagttgcacggtttagagggcgtaaatgtgtaacacaaaatgttttaactgcatgcactccaaataaacttttcacatatatcctagctggatgggaaggtgcgacgaatgagagtatatgataaatagtaaattaaataatatagaccacaaccttacggattgagagtatatgatggtatttttttcatctcaattaacaaatagtaaattaaataatatgatcaaactaatcacaaattttccttttataacgtaggcaaatattatctttgtgatgttggatacactaccatgcctggcttcatctctccatactgttgcgttcgttatcacttaaaggaacaaattggtaggacacccagaaatagtaaggagttattcaatttaagacactcttctttacggtctaaaattgaatcaacctttggcatattgaagaatcggtttaaaattcttttggcaaagcctaattatccattccccacacaagtggacacggtcttagcatgtactatattacataattttattataattgaagatccacaagatgacatcttgaatgagaatgtactaattgatgaggagaatgaggatgtgacaaacgaagatgatacaaatgtagttgacttcactcaatctaggacacaaagagaggagcgtgattcaataaatgaagaccttagggaccaaattgcatgggcaatgtgggttgattattgtgcaaaataaagatggcgacaccacagaaattggcttgtagttttattgtttttacatatttcagactatattttaatattttataattgtgcttgtatgaacaatgtaatttcttatatttaattatgtattttttttatttcatatttgcacttgtacggataatgtaattgttcacatattgcagctatgtaattctaaatttctggtttgtttttattataacacataggtatgtctaacaaaaagtgaggaaaataaaatttgccaaatttaccgcatgcaccactaattgattcaggcggtattaatgtgaatttcgttccatattcaaatcaaccactcaatccgcctcatacaatgccgccttctttcccacatctcccactattagaagggaactatagtggaatgagacaacaacatgtttcattcactaattctttgaacagaccccaaggcttgtataatcccactttgtgttctcaaagcagcggtccataacaaatgtcaccaacccccggtgaatctggtggacatcaaagcaatgtcattaatttgagtcaagaggtgttgtcaccctctaaaaaaaaccaaaaaatgactcaaaagagaaaagtgtctgcaacacaaggagctcctagcctcaatttgaagggggtttctaacatgtggtggctccccgagcatgatgcggagcttataccgtgtcttgcgaagctcgcggatgccggaattaaagttgataaaaacttcaaagctgaggcttacaaaatagcagctatgaagatgaacatgaaattcaaaaccagctacacccaccttcatgtgattaatcgcatgaaaacttggagaaacaaaatcaatgatatgaaggcttgcatcaacataagtggtgcaggtgggaagagaaaaactgtatggtaatcctagatgaggagacacttaaaatatgggctcacgtattaattttatcataacaacacatttaatttatttggatgtgagaatgttataattaatttcacacaatatttttcacatattgcaagacaaaaggaattcaaagctaagaggatatataaacaagtctcttcccttctacaaacatttacagaagatcatgggtgatgatcaagctacgggtgattttgttaggccagtttatgataagattggtactaacaatgtcattcctcttgatgatgatgatatggacattccacttgagagtgaagttgagccacagtctgatgctaacactaccccaaactccacttctagaaaatcccaacttgaatccaacacaaagccatcttcaagcaagagacctcgacactccaatgatgatgaattgatacgtagctttgttgagtcaatattggagtcaattagaaatcaacacattatacattggactgaacaattagttgcagctttgaagaaccatagtgactcctatagtgaagaattgcttgataaggttttaaatcatttgtatgaaagtgagcgtaaggctaggaggttttttataaaaacgaaggaggctcagaagaggttatcatttgtatgaaagtgagcgtaaggctaggaggttttttataaaaacgaaggaggctcagaagaggtttcttgcaagtcttgcttgagcgtaaggctaggaggttttttataaaaacgaaggaggctcagaagaggtttcttgcaagtcttgcggcggctcaaggatgggacacgtcatagtgctttgttgttctgtgcacacaacactcaattttgctacttcacatgtttcattactattccctcacaaacttatattttgttaattgtaaactttagatgttactattcatgttgctatttcctaaatacctacactaacttatattttgtgtattacaaagttgatgatgttgcaattcatgttgctagttgtttttgtttagttctctattgttgggttttttggtcgatatttgtgctcgttgtcgagctttggggctgttttttccagttagtatgttaattcgtgcttgtttagctctctattgttgggtttttggtcgatatttgtgctcgttgtcgagctttggggctgttttttccagttagtatgctgattcgagcttgtttagctctatattgttgggttttttggtcgatatttgtactcgttgtcgagctatggggctgttttttccagttagtatgctgattcgagcttgtttagctctctattgttgggttttttggtcgatgtttgtgttcgttgtcgagctttggggctgttttttccaattagtatgctgattcgagcttgtttagctctatattattgggttttttggtcgatatttgtgctcgatggttgtcgagctttggggctattttttccatttagtatgttgattcgagcttgtttagctctctattgttgggttttttggtcgatatttgtgctcattgtcgagctttggggctgttttttcagttagtatgctgattcgagcttgtttagctctatgttgttgggtttttggtcgatatttgtgctcgttgtcgagctttgggactgttttttctaattagtatgctgattagagcttgtttagctctatattgctgggttttttttgtcgaaatttgtgatcgttgtcgagcgttaggactgtttttccagttattatcctgattggagcttgtttagctctatattgtccggtcctgcttctggtgggccgcctcgagcatggtcgggctagggatttgggtggtaatggttcgatatgtgcgcgaaggtgattttaggagtacttccgcagaggctgcaagttatcaagaaagcaattatgttgtagtaggttcagattatcttgtgcatacggatttgtgtgagttttatgatattttgatgctccaatagatgtggagatctaatgacatgtgatgttgtagttgatgtcatgaactgctgtggtgaacaattggcaagatgcttaacattgtatcttggtaagtatggctctcagctttttaatggagagcctagaaatacctagttaaagcctgattaatgggaattatttctctttcactgctatacttttcagcagtgcaaaattcagttgcaaaattttgtatatgtgcatagttgatgatggaagtattttataagatttaataatatgaaacaaaacggtaaactagccattaaagtgataaatatggtacttaacacttttctataaatttggcatatgtaaccaaacaaaagaaaaagaaatcttgttattttctataaagttatgggttattttcttgttttgaactaaacaagcaaagtacaaaaaacaagaaaattggtacttttgacttctcaaaacttttcctataatttttttaagaactacaaggaaatcatatattggatggaaaatatttcctataatttctagaagaaattgaaccaaacaccccctaaacgtgtgaagctgagttcaagtgaggtaaaaaaaaaaagcaatgatagggatcaaactccgaaccacaagtgaacgcggggggcttcctatcctacctatattgctgctcggcctctgatgtatgatttttaactttgaccctgttgtcagagtatatgataccacaaacaaaaacgcgttttggacccttttcatatagagaatgatatatggatccttgtccgacatatgggcctataatggatttggagattagggtactagttttggcccgattacactcagacacttgatcacggtcattctcatgtgttgtctctaaaattgactctatatatgcatatgccacatgcgtgcatgcttctctacacgtgtgatgagtttgaaatggaccttctcctatcttttaccaaagtagagttcatttttctttctttcacaaaagaagtctcttattaaggaacttatattgagtatgaattacttaagtctcttatcaaggaacttatattgagtatggtagagagttcttgtagtggtgacatgggaagttaaatggagggcttcagagccattaggaagttcttatgtcttccatttcattgattaacaacacacaactctgaggtcaaaataggcggcttttttttaggtataatttgaaaatcatgcttgtattaagcttgtatctgctaattaacttcagtagcattgctatttgttatttagatctcttgaaattcgaaggaaggttatttaattaatagttaataattttatacgttgtaaaagtgatgatctgattcgggtacgttcaagctttggagctcctgcatttactctgattcaaacttgcttactgcagtcacaggaaatgcatctctattttttgaccaagttaggagaacattttggttacttgaaatttttaagcgctaaatctccattttttttttcagactgcttacacttaagtcagatttgccttcaactcatccacgtcgattggggttggacttaaacctctcagcattttattatgagatcatgaaccctgaaagataggaggtaccttttaagaaaagtttggcacaaacataccatcaagttaagcaatataaattgcaagaataaagtttctccttcaccaaataaagctttgttattaataatgtacccaaataatactaactaaagtttcttcacaaataatgtacccaaataacactttgaatattaaacccttcaaagtgtatcatattcaatagaatttttgatatacatacaataaaaacaaaaggagattttttgattaaaggtttaaaatacaagggctgaataaaaaaaaaggcaatgtatttagggttaaaatacaagagggaaataatccggtgggttgagacacatccaagtttaaattttaaagccttgacataattttcccagtttaaattcttgatctcctaaccaaacgcaaaacaaaagaaaaaaaaccaaaaaaaaggaagagagaaatcaagaacaggaagagggcgaaagagtgggggttggggggtgggggggttcatgttcgggacggtgtagatggaatgacgactccaggcgtctgccattagggcatttctgctattgagccactctatatccgatatcaatcgagaaacccaggtttcaaacatgtcgttgaatcttgatcaagaatctgaatcttggaacttggaggagagaggtctgacaagggagatcgaagaaaggtgaatgtgtccgggacggtgtagatggaatgatgactccaagcgtctgccatcagagcatttctgctattgagccactctatatccgatatcaatcgagaaacccaggtttcagacatgtcgttgaatcttgatcaagaatctgaatcttggaacttggaggagagaggtctgagaagggagatcgaagaaaggtttctcgattgatatcggatatagagtggttcaatagtagaaatgccctgatggcagacgcctggagtcgtcattccatctacaccgtcccggacacattcacctttcttcgatctccctactcagacctctctcctccaagttccaagattcagattcttgatcaagattcaacgacatgtctgaaacctgggtttctcgattgatatcggatatagagtggctcaatagcagaaatgccctgatggcagacgcctggagtcgtcattccatctacatcgtcccggacacattcagaaggattagcccacagatccataagccttcaacgtgcagcatcggacctcggcactatgcctcttcctgttcttgatttctctcttccttttttttggttttttttcttttgttttgcgtttggttaggagatcaagaatttaaactgggaaaattatgtcaaggctttaaaatttgaacttggatgtgtctcaacccaccggattatttccctcttgtattttaacccctaaatacattgccttttttttttctgcccttgtattttaaacctttaatcaaaaaatctacttttgcttttattgtatgtatatcaaaaattccattgaatatgatacactttgaagggtttaatattcaaagtgttatttgggaacattatttgtgaagaaactttagttagtgttatttgggtacattatcaataacaaagctttatttggtgaaggagaaactttattcttgcaatttatattgcttaacttgatggtgtgtttgtgccaaacttttcttaaaaggtacctcctatctttcagggttcatgatctcgtaataaaatgctgagaggtttaagtccaaccccaatcgacatggattagttgaatgcaaatctgacttaagtgtaagcagtctgcaaaaaaaaatggagatttagcgcttaaaaatttcaagtaaccaaaatgttctcctaacttggtcaaaaattagagatgcatttcctgtgactgtagtaagcaagtttgaatcagagtaaatgcaggagctccaaagcttgaacgtacccgaatcagatcatcacttttacaacgtataaaattattaactattaaccaaatgaccatccttcgaatttcaagagatctaaataacaaatagcaatgctactgaagttaattagcagatacaagcctaacgcaagcatgattttcaaattatacctcaaaaaaaaagccgcctattttgacctcagagttgtgtgttgttaatcaatgaaatggaagacataagaacttcctaacggctctgaagccctccatttaactttccatgtcaccactacaagaactctctgccatactcaatataagttccttcataagagacttaagtagttcatactcaatataagttccttaatgagagacttctttgtgaaagaaagaaaaataaactctactttggtaaaagataggagaaggtccatttcaaactcatcacacgtgtagagaagcatgcacacatgtggcatgtgcatatatagagtccattttagagacagcacatgagaatgaccatgatcaagtgtctgagtgtaatcagcccaaaactagtaccctaatctccaaatccgttaaatgcccatatgtcgaacaaggatccatatatcattctctataaaaaaaagagtccaaaacgcgtttttgtttgtggtatcatactctgacaacagggtcaaaattaaaaatcatacatcagaggccgagcagcaatataggtaggataggaagcccacgttcacttgtggttcggagtttgatccctatcattgctttttttttctttacctcacttgaactcagcttcacacgtctagggggtgtttggttcaatttctagaaattataggaaatgttttccacctaaaataggatttccttgtatttcttaaaaaaattataggaaaagtttcgagaagtcaaaaataccaattttcgatcaccagtgaacccccctgatggcagacgcctggagtcgtcattccatctacaccgtcccggacacattcacctttcttcgatctcccttcttagacctctctcctccaagttccaagattcagattcttgatcaagattcaacgacatgtctgaaacctgggtttctcgattgatatcggatatagagtggctcaatagcagaaatgccctgatggcagacgcctggagtcgtcattccatctacaccgtcccggacacattcagaaggattagcccacagatccataagccttcaacgtgcagcatcggacctcggcactatggagatccgaatctccatcgtatggaatgtcataaacacagggccttacagaacttcctcgtccgatgtcgagtgtcgatccatgacatcatagaagccctgaacaagaacctgcacgacttcagagcctgctatcaagatcttgatacattttggatgaaaaatgatgatgagttcctaagaatcatgctttatgatggagcattcatgatcgaaataatgttagcgacctttgaaacatatgtgtgcgcaccttctagttatcacgcaaaggacccagtattcaaaaaaccatacttggttgaagatcttcgtgtagatatgctcaggttggataatcaaattccaatgaaggtcctggagatattgtctgaattctgcaaaaacaaggtgatgaatgttaacgaaatctaaatcttcatacctttaaatatccctgttgtaactccaaacttgcacaaaattttcatacctcgtaatgtaagattaacctaacagtcaacattgtataaaatgatacattatgcaatgaggatactcccacaaaatttgctattcattgatcaaatcattcccatgagaattttttgcaaataaatgagtaatgtgcatgctcaagatagcagtcaccatattgaaatccagcagaagacactatttgcatacgcatcatataagctctattgaactaagacctggataaataacttctggatagataaacttttttcaaatcctgcagaagacactatttgctgtaagtgttgaactttgtgtatggatccctttataaagcaatcacaatttatgctgttgcttaaagtaaataacttttttctgtcttccagattcaaagcattcaccagctaatcagacatttcttcttccacaaatatgaagagggaagatatgatattagccaaacctctaggatatttcacctaacggagataacagggcatcacctgctggatgtgtacaagaaaactcttatacagaatggaggttatcatcacaccaacagtcgccaaccactatcggcagttgaactacaggaggcgggcgtaattttccagtgcagtgaaacgccatcattaacagatataagcttcgccaaagctgtcctttgcctacctgcagtcgacgttgacaaagcatttgaagttgttatgcagaatctcattgcctatgagcaagcacatggcgaaggtcaagaggtaacatcctatgtgttttttatggatggcattgtaaacaatgacaaagatattgccttgcttcgagagaagggtattatcaggtcgggagtaagcagtgataagaggatagccgatctttttaatggactgacaaaaggtccagttgcaaaagttgtcgacaatgttgatgttgatgtaacccaggacatcaatgactattgcaatagaagatggaacaggtggcaagccaactttaagcagagatactttacgaatccatgggtaacttgctcactcattgtgggagctctagtattaggtctcaccattactcaatacagtatatgatgtcctttcttataataagtgaagttaatgtaactctcatactcgaaaatgtatggatgattccagtcttgatcccagtcttttgtcctggctgtgtggccattgtaagcattgtaatttgagacaatgacaaggatgaataggctaatatcaactgaaaaaggttcataaggcagaaggaaagttgttacgagagttgagggttacatttttatactctaacatgaccctccaagtgagcgcacactttcatgagctgaatctggacttttcttgtaaaatccactttagaaattcaaagtcagtaaaaattgaacctggcttactctagtaacatgtcaaaacacaatgccaataaagcaaaactctgaagttgtggtgaggattgaagattacaatttcatattctacaattataaacccaaataacccaagccatctctcaataactgtctctgtgcagtgacacacaaaggtgactgacaccttggccagtttggaagtaatgatggttgtctttaagaactttgatattctgtaattctagagtccttgggtttgacttttgagtttcaatggtttcaataattcctgacagaaacaaggccaagaatcaagatcttttctgaactaggttttccgaatagatctagtaacaagtgatcccaaaggatgaatcaatttctgcctaaactccaaagggtccgatcaaaggtaagagaaacaaatacgaggagaaacggaacaaagaacaccctggtactgagaatccccttcccaaattgctaccaaatgcaaaaacttttagagcttatgacgagttccagattcagggtttttcgtccttaattgaacttgaaaccaatgggctgccaatctcttggtaatttccctaaacctagttacattcacttgatctattcctcttttctaaagcaaatatccctagatagcatcttaacacttgaaagctgcataatcttcctttcaattcaaaaagcaaaatacatataactgaactaaaaagtagagacattgttggtaatgaaaatgaatatatcatcttgatcttcttcacaaatttgattattttcctcacaagtctatcccatctattcatatattaatattcctcctccagggtttccaaatttgcgcacaaattccaacaaagaagtgtctggaacaaacaccaatctaaagttacaaaaaactgatgtttcctgatacatacaatcatcttgttgctattgctataattaggcatattagaaatactaggaagcatgaagtagacaacaagaagaaaataaaatgaggttttaatctcaatcattaactaacaataatacagatagatcaaagaggaattagagaaaaagaggagaaacattttactcgtgataaaagaaaaagtattttagcagtaacactcttcacaagtctatacacccttcaaaacccagcttttacatgaagcaatcaccactcttactttccaagacctatttcacccttttcatccttccttgagatccctcaccaagactaaaaaggatatataaataaataaataaaaatagaagttatagcatttaaaacaagcatgcaaacaatgtccatccgtaattttacagatggatatggnnnnnnnnnnccatccactattcaccaaaagaagaaggaacatgagacacacccaatccttcctttaccttcctctcattttcctcattaacctctttgtagcccttaagacaaacagagcaatcaatagagaaataaaaagagagcacatacaggaatcgccaaagaaagaaaaattcacttttgaggtctgttgcatatccacaagctccatgccttgcacaaaagtcggaaagaagaaggtaatgtgatacatatcatttcagtctgtcttaaaactacccccaaagcctcttaatcgaaacatccgacaaagaaggtgacgtaaaacatatcatttcagtcttttccccatgattcatcgtgtgggtttgtttaagctcaacgtcttccattatacagtgtctcccttctgtctcttattatatctcttctatttttccccttccattcttgacttattccatcttttcttttggcccttccgtatttcattacgctgcttttccgttgacacgcattcatctctcattatgcctccctcttcacttattacatcttctcttttggccatcccatcgccctccctctccctcaaaaaacacacacacacacacacacacaaagaggcaaagtccctcccgctctccttcattcaccataatttgctcatgctttcatctctgttcctccatttgttgttgcggcatagcagctacacttctaccataaattaatgtgataaagactggatgtaaatgaattcttactaaagcactcatacattcttcctatgcaaatattctaaaaagtataagcctattgaatatattctaaaatagatatagtacaaaaacaaaaaaaaaattagtttataccatatattctaaaatagatacaaaatgagaagttcttttgtttcagattgatcctgaccaatatttcagaatgtcctcctttatattaccagaatattggacaccccattataatgtgttcaaaccataacttcttcaaaatgaaatacaatgttaattatttctttatgcatacttcaattactcttggactttgccattaaaagagggatcatggtcttaggccagttttggcaaatgtttacgaaggaggattaaagagaagagttaacatatagttagccttattgttaatgtgaagggctaaatttgttaatctgtgaggttattttattttaatccttattaccatttttgtgtttggaaataacaagaattatgaccactttctttataaaaagaggggtttatctcttaatctatctaaatatgtggatatgtaaaaccctcgttttgagggattaactcatgttaatccctctaaaagtatttgtaaacccttcttctatattttgtgcttggcaaattaggaggggttgactcagttcacacnnnnnnnnnnnnnnnnnnnnnnnnnnnnngtcaaatctccttaacccttcatttacctatttgccaaaggaggtctaaaggttaagaccgtaggtcatagcagtatgccacatttctgaagcaactgggaaagtgccacatttttgaagcaattagggaaataaaatggaaacaagtgtgccctggaaatctttctaaaattcaattaacacgaaatatccttcaaaaagactatttcccccttaaagacactatcacaaagcctacatcattgccctttgaaactctcattccatttgcagtatattctaagtgatggtacaatattcaaattcaacatcttttccaaagttcatgctaaagaagatcacagagttgaagaaattcaacatcatccaaacttcaattcattcagcatcttcccaaacttaaattcattacatagaggccccagcgcttcaaatttgacacccatcccgaacttaaattcatttcatagatatccaaggaagtcattttggtggcagacaaaaaagattcgtttttcttgtttttaacctgaatatttaattgcctgtcaaacccacaaagaaacctaatgttttgaatacatacccaccaatttatgtgttcctcttctgaccctctcaagagtccatgtgaggatgatagatgcaattcactactaaatttcatccaaaaatgtcccttcacctccgattacaattgggaatgattgcataaatacagagtcatgagtgttagcaatgttttctacaaatctcatgatttaaaaaaaaaactgctatttttgccaatattacactgaagaaaaaagcagaatgacactgtcagaaaggagaaatggatcacagaaccattcacataaaaatgaattagcaccaggtgaagacatgaaaggtctagatgaagtttatttacaatgtgaaaataataatttacaatttgagtaagtgttacacatttgcatattgtagagatcatgcagcatctaaatgtgaaagccttagaccttgcaagatccttacccaaaaaaacatatgcaaacaaagaaacaataactagacataaatacgtatgtatgcaagaaactgcataaacacaaaaagaaagaaatatatatacaatgcagaggtgaattctatacagtttacgctgcctctgaaattttcagcctaaaaaaaatctccctgtcctcatgcatcgcacgtgtacaaaacaatgccatcctaccaatgacatcttgacacgtcattacttctaaaaaagaatggtctatatcatacatataggacttagaacacggtgattgcatacaaaacatgaccctgttggctctatcactccagctccagctgcataacattaataaaaccccagctaccatacctaaagaatggagggtatgaactaaggagtattctatagaagggatttgacaaggtttctacagatctaaatggtcaatggtaattacaacccttgactacttgaacacaaggaaacatccacaagctaccgagtcttaccaaaacataaatttctcaacatcaactctacaacaattttttacaactccaaataaatttctaatcacattcttcatctagctggggcttcttctcatacagcaaaaaggacttcctagtgcactcatggcacatatatggaaatagagtataaaatgccacttttatgaagcgccttatgaagtatcttgtcaggtaatccaagctatcatgtttatggaattcatttaaaaatagcagactttagttgcaagatgaaggcaaatacaaaaaatgaaaaattaatgaatgagaaaccacagtcatgtctgtacctacagtaaatcaatataacaagttatagaacattctacaatagaaagtgaaacccaaaagtaacaatatgtcctacagttaattttaatgctgaagtaataagttattgctactcgagactcaaatgacatgtaacaaataaaccgaaagtcaggcattatcattttgcaataccaggataatgaatatttcaggcaaaacaggtaactcgtatcaaccaacatatatcaagtaatttaggttaaaataacagaagttgtacaacatgcaaatgaagattggcttctgatatgtagccatttatattaatagtattcatataattttgcatatagataaataagatattagtattttcggcaaataaaacctaagacatgagcacaaggaatttgcaacctatcaatataacgcataacagcgaagaaaacaaccattaagtacgcaaagaaacaggaaggaaaacttacttctcaagagtaatgactgcaagatgcccccacaaatatccttggcaattatacaccaaaaaacatacttcatgccgaggaatttgcatggactccctttcactctgatccccagatgcctccttttcccagtcatcatctctctccatctcaacctccatagagtggctgtgacctagatcttccttttatcccagtcatcatctctctccatctccagctccctgtgcctctatagtgatccgcatatctgtctctatcatcccaatatcttccctctccctctcccaatgaccatgactccctcccctatcccttcccatctccacatcatcctgaagcctcctctccctatcatccctatgcctcctccctcacctctcttgcccacctcctgcatccttctgcctcccatgccttctttcaggtccacccaccccttttgcctgtcaggttccgggccccgctcccctacccctctccttcccatggatgacatcctctccataccgatgatctgcacctgcacctccaccatagtcaaaggcctcacccagcattggacccgggtgcatcaccggagttcgggtgtttccccattatccctccgcctccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaattggcataaaatcggattagattagcataaaccttattcacccccctctagggttttttcctagcggccttagggtctaacagtgggtcccaccgaccccctcctctcttgcgtgatgcatcacgcgcgagacaaacagcgtttttgttctggagaactggaaagaattcgattcaagagtagggtttgtttaattattttcttcaagaggtgtggcccacctttggggctcttgtaattgatctgggccttcaatttttgggccccatttattatactttcgaccaagtttgagctgggcaaagagttgtcgggtgggggagaggttaataccggaggattgaggaggaatgatgattgattaggggattttttttttttcatttttattttcttttcggatctcgagtgatgaggggatttaaaacaaataaattttgtttagcttagttattataaacaattttcaattatatataacattgtattgttgacataatatcacaagataattctagggttttcaaaataaatcaaacaacaataaaccctagaaaaataatctaacacacatgattaattcaaagaggaaaataacaatagatgcagggttacttaaatatatgcctgtaggcgtcaaaaaatgctaatagatatcccaaacatagagaagattactcaaagggatctcatattgaaaatcaaggcaggaatgaactgtctcgacagcgagacaggctttgctgtctcgccagcgagacaggctttgctgtctcgccagcgagacagtaaataacggagtttgaaacgtggaagaacagttacagcgagaaactgccattttccgagacagcatttactgtctcgctgagcgagacagcaaatttactgtctcgcgggtcgagacagcaaacgctgtctcgcccagcgagacagtaaacactgtctcgccgtactgacttcttcgattgttaagtttttgcagttacagacccttgaggctataaatacccccctagggtcacttctgacgaggatcgagcatttgttagagcattccagagcagagagagcagagatttgggttcttttcttgcaacgccttgaaattaagctttgacttgattttaagaagaacgactatcttacttcgataagatatcgtttcaatttctacttcgataacgaagttagaatcataagccccctcttcacgatctgtgaatcggcggtccacgaaccaaagcgttcccggcacaggcaaagtcccacgaaaacaaagatcgatagacgatttttgtgtttgtttctcaaaagttgtaattttcgctttgttgtgtagaaaaagtcttataaaaagattattctttcgaatttgttgtaatcgaacaaagttataatgaattccacagcagcgacttttgaaccaaacaagctggcgaccacagtgggagccagcggcctcgctgccgaggccgcggtgtcgcaaccgatcaagatcatcgttaatgaagagatcgaatatgagttcgatcaggcaaaatttgaggagtacttgtcgtcctcatccgcgaaatcttcctcgtctcgcaaatataggaagatttcgaaaactttcaagtctgcagtgtcaatgaagaccgcgggtgaaagttcttgcccggatgttgctaaagaatctacttgcaacatatctgctccgaacgactccacacccattcaggagtcgatgatgaatagctcgccggtgctgacgaagagagctcgtcagagacagcgccagcgccgtgctcgacaattggctaaagccatgcaacaaaccgacggggtccattactatgtggacctagagtcgaggagacagaaaatgattcagttgcctcaacggcaagataatcatatctctgcacaacttacgacggaggagtggactctcgtcaaaagggcccgttcaacccttaaggaacggatacaaaggcgtaaagcgaaggccgcccatgctcgtgctcttcgtcaacaagcccaaggaaccaaaaaggagacggtgtctgaaaagcaaccgaagaatcgtagagtctgggtgccaaagaagccgcaagcatctgttccgggcccgtctactgcaacaccagtagaaccctgggttagcccagatttgtccaagttcaagataacaatggcagatcgccttggtccttcagttgatcgaggcaaagccccagtcaaggaacaaccatgtccggcaaataaaccattaatggtttcatatgcagggggtcgtaaacaccctcctgtcagaactgcacaagtccaaaacgagagaataccagttcactctcgtttaggacctctgaaaactccacaccagcaagggggtggattcaaaaattcaactttggatcgttcagaggcgacgaccagtcgtcctgtgcatgttaacaaagttcagaaacaaaagataggttgctcaagtcataataacgacgagctgtactatcagaaaaacaattcaagaaaaaggattgttcgagaaaatgagtctcattgcgcttgcgagagactcattaaagcagtgttgacagaatgtggatgctctaagaataattcaacaagagtctccgtatttcaaagattgtccaatgaagcgtcaagacccaaaatgagacgtttcaacaagaagaaacctgcaatccaacaagatgagttccctgaggtcactatcaacatgaccaataaaggaaagcaaaagtcagtcaatcctgaccctgatttctctccaggagggagagttgagcggggtctttctcaaaggatgttgcgattgcaaagaagagccaacatacgacgagactacaagagaatgcacgagggactatcttcagatgaagaaatgttagatacttgttccgccattacgtcggacgataccgcgtccagtgttgggcaagtcagagaatcatttgcagtcacaccggatcaactggctcatatcctgcaggaggcgttggctaaacaacgcgaagaaattagagctgagttcaaaaccgaaatggagttgactatgcagcagatgcgagacttgcaggttcagcaacaccaaccggagttaagccagaaagcagaatccagccggcgtaatgaagaggatgagactatctttgatgatcctcctccagataaagacaactccggaagtggtccgaccaagtcatccactcaacctccgcaaatctacttgaagaaaagcgaggaagaggacaagaagatgcacgatctcgagagcaaagtcaacgctctgatgacggctcaggaagtgaagaaaacgggcattccatacccgtacccgagggagtgggacccgattccttatccccagaaatttaatttcattaactttgctccttttgatggcaggggttcaccaactcagcacttgatctatttcaagtcgcatctcggcgcaatatctgggaacgaagccctgatggtccggtcattcgtaggaacccttcgtgggcctgccttcgattggtaccgacgccttaagcccgggagtattactagctgggagaatatggaagaactattcctcaccaatttcttcgacgatgacacagaggtttcaattggcacgttgttggataaaaagcagaaggatggggaatcggttgacgtctttgtcaaacgattccgggacaaagcggtgaactgcagagatccactcacagaagagttcatcctacagacatgtcacaacaacttgtcattggatgtgttagaggtgatgggggttgtgccctctaaaacttggaaagaattgaaggtgagaggtgaacaggctgaacgctttctcaagaggaagaacttggagagaggtctcccaccaactaataatcaaaagcagaactttaatcctcgaggcagaggaagagggtctgcggcagctgttgatgctcatcaaacatcacaacagccgcaacaacaaccgcaacagtcatctttccaattagcaccgaatcaaaatcaacaacctccgaggcaacctaagacttcagagcccagattcccgaaggagtattctttcaaggatgatgaagtaccagttatcttcaaatatctccaccggtcacaaaccaagaagaagcaatgaagattaatgacccgaagtattgtgcctatcacaggagggtccaccatccgactaagacgtgttatgtcttaaaagacaaaatacaaaccttaatcgatgttggcatcgtaacaccgaagccgaaggagaagaaagtaggtgcgaatgcggtgtctatcagcttcgggtcagttcctttgtcctggtttcaagtcggtgcctatcacaggagggtccaccatccgactaagacgtgttatgtcttaaaagacaaaatacaaaccttaatcgatgttggcatcgtaacaccgaagccgaaggagaagaaagtaggtgcgaatgcggtgtctatcagcttcgggtcagttcctttgtcctggtttcaagtcgagctagtgtctaaggtcaaggtgcaaaccatcaacgatgacccttacggacagcgccaaaaggggcttatatctcacacaacccccaacggcgaaatcctttgggttcatccggatctgctcaaagatgaacagtggacaacatccacatcaaagaagaaatcaaagggcaagggaaaagagaaatcctggagaggttcaaattccgaagcagtctcgttttagtcgaccgattggacgagacaaaccggaaagctcgaacgcaccatatcgtttcgacgttatggctcagctggctaatatcccagcaagaatcacattgtacgagttgctgcgcctctcaaaagaaaccagagaagctttacaagaagctttggctgattctgaagtattcttaactcaggtcaagccagctcctgaagagccagaatcgtcagtgcagcattgcaatctggcagccaccaaatttccttgcattgctttcacaaaagaagacatgcaagtcaggaattcaaagcatgatagaccgttatattttactggatatatcggttcgagcatggttaaccggatccaagtcgatccgggttccgctgttagtatcatgccacttcgtttgatgtaccacctcggaattcccgccagcaagttagcctccactggaacggttatctatggtttcaacacaagcgggtcacgaccgttgggaaaaatccgggtgaagtgtcaactcggagatctgaagtctgaagtcacctgctatgtgatcgatgcggagacttcttataatttactgttgggtcgtccatggatccacggtaatcttatagttccctccaccctccatcagtgtttgaagtatgtcgacactaatgaggaggtcaagacggtggtcgcggataagcaaccattcaaggggttagaaaattactttactgactcccttctttatggtgctgagtccgatactgaaccatcggcccatggcacggacagcggagaagaagctgataccgaagccgggttcgattatagtgaaggtcttgtactaaatgacattgaacctcttgtaatcgatcttgacggtgatgaatcgtcggacgaaagttgtaactggcagcttgccgatgaaataataaatcatgatttagagtactcgcattgtcttgatgatgtaatgcagaaattatacgccgaccctagtctacatatgccacttcgttcgtcctgtacgaagatgaaacacctccaagattcaagcggaacaactgtgatcttacccgcaaagacagggggtgaaaaagagatagtttttggaaaaggagaatcatcccctactccagatcatttcttggacagtaattcggacagaaaaaaacccgggcgacatttctctcggtacagttcgcaagcgaatgattatatggcgaaccgaggttatgacctctcactcggtgaaggtctttattttggtcaaggcatattcggatagaaaaaaacccgggcgacatttctctcggtacagttcgcaagcgaatgattatatggcgaaccgaggttatgacctctcactcggtgaaggtctttattttggtcaaggtattagggttccaccccgtcctgcctatgtaccaaaaggaaaaccagataattattacagtcataataggggtctgggttatgcttcatcatccgatgacgattatggccaacagattattaaatggccaacagatcattaaccaattagtagacaggagtggacattcatccgacacctcgaattgggattctgatgtgagcattggagaaaagttcaaaagtctcatgtcaaatatggcaacagtcgatccttctacaacagaagaagacgatcagttgcccacttgggaagatccttggacacattacatgaatatccaatacggtgatcgatttgagcaaagagaacctcctactgaggacaaagtagatcaagttaatatgggtgacgaaagtaatccgaaacccatatttattagtggtgatcttccaccgaacgagaaagaggaactaatcgccctcgttcgagagtatatcgacgttttcgcttggaattacgaagatatgccgggactcgacccagatgtagcaatgcatagccttaacattaaaccggatgccaaacctgtcaaacaacaacaaagacggtttcgtccgcagattatggaagcgatagaagctgaagttaagaaactgattaatttgggttttgtcagagaagaacaacatcctgaatggttggccaatattgttccagtcctcaaatagaacggaaaaatcagaatctgcattgacttcagatatcttaatacggcctgtcccaaagatgactttcctctaccgattacggacgtcatcattgataacacatgcgggttccaagattcaggcggaacaactgtgatcttacccgcaaagacagggggtgaaaaagagatagtctttgaaaaaggagaatcatcccctactccagatcatttcttggacagtaattcggacgaagaaaaaaacccgggcgacatttctctcggtacagttcgcaagcgaatgattatatggcgaaccgaggttatgagcatccagacgatgaaaaacatacagcattcagaacgccccttggtgtcttctgttatactgttatgcctttcggtttgaagaatgccggtgcaacataccaacgggcaatgacaaagatctttcaaaagcaccttcgaaagactatcgaatgttacgttgatgacctggtcgttaaaagtcgcgataaaaacgaccacatcaatgatttgaagatgatgttcgagcttatgagaattcatcaactaaaaatgaacccgactaaatccttccttggaatgtccagcggtaaattcctcgggttcgtcgtcaccacaaaaggtattcatattgatcctgataaggtgaaggcaatacatgagttacaacccccgagaaatcttaaagaactcagggggttgcaaggtcgattggcatacatccgtcggtttatatcaaatctgtctggaaaatgtcaaccgttctctaaactcgcgaagaaaggtgtgtcgttcgtttgggatgaagcatgccaaaaggcattcgaagatattaagaaatatctggcgaatccacctattctcgttgcaccgaaatcgggcagaccgttttttatttatgtcaaagcgacgagccattcgttaagtgcattacttgcacaagacgacgataacggtcacgagcaagctgtgtattatctgagtcgtacattggtaggagctgagtctcgttatccgatgattgagaaggaatgtctcgccttggtattcgcgattcagaaaatacgacattatttagttggacagacaatttatgtcatttccaacataaatcccgtccgagtgttcatgacccaaccggcttccatgaatttacgtttggccagatgggctttactcctatcgcaatatgacttgtacttcaagcaacagaaatctgttaaaggatgagctatttgcgatcttctggcggaaaaccctacgaaggatgtagtcgaattgtacgacgatctgccagatgaaactcacgaagttaataccacctcacatcaacaagtgtggcaattgtacttcgatggggcttcccgatcaaccaacgtggcaagtgcacctggatgttctaaaatctcctcaggagtgggggtcgttttagtttccccggaaaagcacgttttgcctagagcatattcactgaccgaaccatgctctaataacgtggctgaatacaatgcattaataatcggacttaatttcgccaaagagctgggggtcgaataccttgaagcttttggagattctcaactggtggttaatcaaatacgaggagagtatgaagtcagaaatcgagacctgattccataccaccaggtggccatcgaaatagcaagctcgtttgaagaatttttcatcgagtacgttccgcgtctccaaaatacatacgcaacagagcaattgattacagtgaggactcaccagcttattgttccaatctacgattcgaatgctaaagaagtatactcaactggagttgaactcgaagttcgagattagcgctttcccattatcgactacgtcttacatggtatattacctgaagatgtaagagaaagggaatcgattcggcgaagagcaccgagattttactacaatgccacaacgcaaacgttgtatcgacgatcctatgatggtcttttactccgttgtttatccagcaaagaagcggaacaagcacttaaagaggcgcataatgggatatgcggtgcacatcagcccggtcctaaactctgtgatcgacttaggagaatagggtattactggccaactatggtaaaagacgcagttgaatgcgcccgacgatgtgaggtatgtcaattacatgcaaattataggcacataccccctgagtatcttcatccttcggcgacatcgtggccgttcgaaacatggggaatggacattgtaggtcctatttttccgccttcggttaaaggagactattttatcctagcaatcaccgattacttctcgaaatgggcagaagcagttccactccgagaggtgaagacgagtgatgtgatcaaatttatcaaacaccatatcatatatcgatacggtgttccgaggcgaatagtgcacgacaacggtcctcagttcgtgagcaacgcgtttatcaagttctgcggtaaattcgggattaaggacgtttcgtcgactgcttataatcctacggctaacggattggccgaagcttttaacaagacaatcatcaaaattctggcaaaattggtgaaaaccaataaacgagattgggacgataaacttggcgaagctctctgggcttatcgtacgaccgtccgtacgcctactggagccaccccgtatgctttaacatatggatgtgaagccgtcctccccttggaaatacagattccttccctccgtatcgctctcgtaacaggaatgacgacggaagaacatcatcagaaacgtcttgaggaattagagatgttagatgagaaacgcttggaagctcaacaacaaatcgagttttatcaagctagaatttctcgggctttcgataaaaaggtccgacgacgaagctttaaagaaggagatctagtgctcgctgttcgaaggcctatgatcctcaacttcaaaaagaaaggcaaatttgaacctaaatgagaaggaccattcgtgatagagacagtctattcaaacggtgcttatcgtctgattactcaggatggcaacaaattaatgatgccaataaatgggaagttcctgaaaaagtattatccataatacgttcaggataacctatgtaaaacgggaagttcctaaagaatcctgtataggatatttcaggataacccgatatcagttgattattctaaataaagactgatcatgtgaataatctattcttaattgttataaaaaataattaagatcctcatattacttttgttgagatgagatttaatgacagttaatcttccctcagcaaaatcttgtaatgtaatcatggaagaggggattcaataatttgtaatctcacaccatgaaaccctcactgatcggatcaaccaatagtcatcagtctgtatcagtcaacaaattattttgtgtcaaattcttatgtttgaaatcaaaatttcccaccgagtagtttgtgcaaatcaacaaactcattgttatttacaccctactcctattcctcacttggtcaaacctttaaatagttaggaccaaagccaaaatcccttctcgattcattccatgaacgagaggtccacaaattgagcaatcaaactttcctacaattaggatcatctcaaaacccccacttggtcaaaccttactacagttaggaccacagccaaaatctcttttcgattcattttttgcgaacgaagggtccacttttgaattgagtaatcaaaccttatgacagttaggattattcaaaccaatccagattctctaagtggatatcccactttgagtttctttactccaggagatagaatataaaattcttcctctccgattctgggttcatctctaccaacaaacaagagatcaggagatagaatataaaattcttcttctccgattctgggtttatctctaccaacaaacaagagattgagaaatggaatatacaattctttttctctccaattctgggttcattttcctgtataggaaatataacctactctcattccaaaatccatgtcgttcacacatgggggaaattatctctatcccttattagagataatcctgcatctaacacatgtagcctacatattcaatatgatagttcaaagtctaaaagagtttagggggaagttatctttatcccttattagagataagcctacatctaacacatgtagcctacatattcaacattgtagttcaaagtctaaaagagtttaattcttttagcccaacgttatatgtgaaacggacctagataattcaaatactagcccgattcaaacggtaatcggtaaaggcatatcaaatccgttgatggctgaggatttgccaaaaatcctataagtattatggttatttattctaaacaagaatgagtaatcataataaaaatctcagtgagcaaaaagattcaatatattgaccaaaagtgtttaaacaaaactacaaaaaatatatgttctccaattacaaaagtttatattgactaatctgattttcaagttttgaaagctctaatgcataagcctgttcaagctcagccgccaatttaattttgaaggcttcttcatcaacactgtgaagcgcggcgacctcttgttccttttcagcaatcatttggtcttgaaggttcagttgctgtaataagttgccttcagtgtgaatttcccgcttcaactcggactccaagacatcatgagcatccttggccattgcaagttcctcctctaagcgagctatttctgctcgactcgattctaaatcccgacgtaggttaacctgggcttgtattctcttgccaacattcatcctaagttgatcgctgtgggctcttagctgttggagctcgagattagctgatgtttgggaatcacgcaacgcttgtagcttggagtccatgcgagaggcaatgtaggaaggtacgctttcagtgcgaagacccttcagaagttcaacatgttgcttcaagtcaaccatataggcgttgatcgaatcgttgataatgatgaaggaactgcgagaaagtcaaataagtcagtacaggatatatatatatatgcatagaagacaacaagctaaagcataccaagttcgacggaagaactttcagcatgacttggttcgcccaaggatggtagtctggattcctgaacagtcaagattggttcaggaatggtagctgttgatgcacccgctacgtcagggactttttcaactaaagcctcagaagacggcgggtccaaactaaaagactccttaagaggagattctacaaacaaaagaattacaataagcataatggaatgataatccgaacttgaaacaaattatgagtaaaacttgccagctctgggtacaacatcggctgaagtaccaacttcttcagttggtctcgcttttgttgcgaccggactgatctggggggtgacggtaacttctatcatcatcagatccataggagtagcaggctggaattcaggaatagatgattggagattaacttcagttcctacccatggcacgaggtcgcgaccctccggttgttcagacgtttcagtgattatagtagtatcagttccagtaactggtcctataattcgaacgcttatataattaatcaagtcaaaatatatacgtatgtatatacggagtttacagagccaaagtcttactctcagaaggacctgcttctgttgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgggagagccggttcctttcctttccttgatgattcagcagcctcttttcctcgaggcgacatcacagcttcacgtgtcacttctgttgcttgtcgtggagctatctcttcctctgagtctgatatcctcctgcgtcgagtgacaatattggcggctatcaaccatttgcaaaagaggaaggtcatccgtaggggcggcgtctctaaaggaagatcgaattcgacatttgtacagccggcgatgctccagaaccaagccctcgcaccgtcgataagtccacctcgagagctaagatggcggtttggattgccaacatatatctgatcatagccgaactgacgggcgaatcgacataggagataaggttcaatgtgacaagtatctcttactctgaacaacagatatccaggtcgaatgttcatcaaccatctgaagcacccgacatccaagatagtgcgattctgccttgggtcttcagcatccaataaggtagtattgtaggtaccggagaactgagggaagcaggggaagaattcccaacacttgtgaattttaaactgcctcgttatgtcgggttctcgatgcctgatccatttgcaattctcgagattctgtaacagagggatgctagaatttgccgtctcaagagcttccattaaatctggtcggtgaagtactaactaggtcatcagataagtgtagggtagctccaacttcggaacgaacagactggcggagggtttctttttctcctgagtaaacacggagattaattgccgtaatccactatgaatatcggccaccatagcggaaagcaaagataatttgcgacctgtaactagctggacggccggatacaacacttccattggcatcgcatctgaagactggtggggaactcagctggacggcgggatacaatacttccattggcatcgcatctgcggactggtggggaaccacgcacctctttagccataaagccagaaaacccgctagcagagcagtagggctaattggaacaccagcttgccacagataagagcggaattagtgccatgcgaaaatccgtcttctgagcgcgaggtataagattgcgcatttgttttctttaacagatgattgatttcgcccgaattcaaaggagacaacccgcatacatctgccgaatggtcatccaaattcttgaatagataatcggcgaattgtttcaagctgacctgaggagatttctttctagctttgggctccatctcggccatggctatatgataatggcaggtcaattcccataaagtatcatgagtcacagttgagctatctttcatcttgttcagctgattgctagttggaaagaactcttgatagggaacatcgcccataggcaaaccagacaccatgcagtggtagtccgagttccccgttcttggtaaagaatgtattagtgtccgggttataaatctcgaacaaacagagaaaatgacctacactactctgcaggccatgcatgctggcacggatcgggacatccaaccctaattctgccaactctcgcccaaaacggtttaacacatatcgggtcatcctggtccaccaccatttgtccccagaataatggacccatccatagcatctaaaagtctctctgggtaatttctttcctgctgccgctaaccgattcttcacggtgttggcttgcactatcttctcattctgaggtatgttgtcttgtcctaagacacccggatgaagcccccgcacatgagctctttcactggagcctgggttggcttccttcccaataaaaccacaatgaatacgctcgtgattttcagtcaacttccagaacatctcacgtccaactgatagattcctgaacattaatagtgagtgatcccgggggataaaaggcagatataagaatgaggacccattctggtgcaaccattgcgcaggctggcagaaagcaatcttcggatctttcaccgaatcaccaaacaagaaatccggcttccttatgcattgattcgagtcttgctccgaggtcaaggtcgcatccgtgattaatcgtcgtagaacacgacaactacctcgctggattaattccctagcattttcgctgtagccagatctgaactggggagaggattcaattaacgggatcccctcgtaataagagtgggtcacgctactccggccagtaaccacatcagcagtaaaggtggtagaaggaaatcggactgataaaagaaacatacacataaattgtgtaagtgtagtcctaaaattttagagaaaacggtatatcttacttcataatatatagtgccatctcacaacaggcgtgatgattttccatctaccacatgtataaaggagatatgcgttactatgcatagacattataacggcataccaaaacctttcaatacacgtgggatgatatgaaatcgcccctgtgtattctgaagtgtgttttgtcaaagcaaaacagacacttttaagcgtcgatcccctcaaaggaggatactggctcttctcgagggtatctcaaaggatacaaacgaggatctgcaaacaaatacagagacatatatatggaactgacgaaatatagtatttaaattcgtgaaaaggtgaaaaaaatatacctccacgagagatcgcagcaggggcagcctcctcagggctctgaacaggtggatggcttcgggttcctcgagctctacgcggcgacatgatgagtatgtgatctacattgaaacccaagaggaaagctaagatttttaacatgaaatcgacaaaaaatagggcaaatacaaccgaaacaatgcatgcacagtcacagttgaagaaaatcaaaattttggagaaaaatgagtgaacagacctttgaaatccgaatgcaatcttcacaaacaagagcaccacccaagtcggcaacaaagaggaaaagaagtagaagaaaactggtcgaaaatcgcccaagaaatcgcctgaaaatcgtcaaaatccgacgtgaaaaagtcctaaaaaaccctaagttcgagttttatactcgctggctcgctcagcgagacagaaaactctgtctcgctcagcgagatagaaaacactgtctcgctgagcgagatagaaaacactgtctcgccgagcgagacagaaaacactgtctcgccgagcgagacagaaaacattgtctcgctgaacgagacaatgaaccctctctgtatcgcattgcgatgcagatgaatactccaatgggtacacgagtctaaactgtattcccaccctcaacaggaagtttctggagaatattaatttgaatattcttaaggataacctgatgagctctcaatggatatatcaattcagtgataaaaaaaactgaacccgcaagaacaagtaccaacttcaattcaagatttcgacaacggtcaagcgataaacgcgacgccgggaaaa

SEQ ID NO: 140 - DNA, 1427 bp, Asparagus officinalis
caacgacatgtctgaaacctgggtttctcgattgatatcggatatagagtggctcaatagcagaaatgccctgatggcagacgcctggagtcgtcattccatctacaccgtcccggacacattcagaaggattagcccacagatccataagccttcaacgtgcagcatcggacctcggcactatggagatccgaatctccatcgtatggaatgtcataaacacagggccttacagaacttcctcgtccgatgtcgagtgtcgatccatgacatcatagaagccctgaacaagaacctgcacgacttcagagcctgctatcaagatcttgatacattttggatgaaaaatgatgatgagttcctaagaatcatgctttatgatggagcattcatgatcgaaataatgttagcgacctttgaaacatatgtgtgcgcaccttctagttatcacgcaaaggacccagtattcaaaaaaccatacttggttgaagatcttcgtgtagatatgctcaggttggataatcaaattccaatgaaggtcctggagatattgtctgaattctgcaaaaacaaggtgatgaatgttaacgaaatctaaatcttcatacctttaaatatccctgttgtaactccaaacttgcacaaaattttcatacctcgtaatgtaagattaacctaacagtcaacattgtataaaatgatacattatgcaatgaggatactcccacaaaatttgctattcattgatcaaatcattcccatgagaattttttgcaaataaatgagtaatgtgcatgctcaagatagcagtcaccatattgaaatccagcagaagacactatttgcatacgcatcatataagctctattgaactaagacctggataaataacttctggatagataaacttttttcaaatcctgcagaagacactatttgctgtaagtgttgaactttgtgtatggatccctttataaagcaatcacaatttatgctgttgcttaaagtaaataacttttttctgtcttccagattcaaagcattcaccagctaatcagacatttcttcttccacaaatatgaagagggaagatatgatattagccaaacctctaggatatttcacctaacggagataacagggcatcacctgctggatgtgtacaagaaaactcttatacagaatggaggttatcatcacaccaacagtcgccaaccactatcggcagttgaactacaggaggcgggcgtaattttccagtgcagtgaaacgccatcattaacagatataagcttcgccaaagctgtcctttgcctacctgcagtcgacgttgacaaagcatttgaagttgttatgcagaatctcattgcctatgagcaagcacatggcgaaggtcaagaggtaacatcctatgtgttttttatgga

SEQ ID NO: 141 - DNA, 2809 bp, Asparagus officinalis
atgtctgaagcctgggtttctcgattgacatcggatatagggtggctcaatagcacaaatgccctgatggcggaggcctggagtcgtcattcaatctacgacgtaccagacacattcaaaaggattagcccacagatccataagccatcaacgtgcagcattggaccacggtacaatggagatctgaatctccttcgtatggaacgtcataaacacagggcgctactgaacttcctcatccgatgtcaagtgtcgatccatgacatcatacgagccctgaggaagaacctgcacgatttcagagcctgctatcaagatcttgacaccttttggatgaagaatgatgatgagttcctaaaaatcatgatttacgatggggctttcatgattgaaatcatgatagcgaccgttgaaccatatgagcgcacaccttctagctatcatgccaaggacccaatattcaagaagccatacttggtcgaagatcttcgtgtagatatgctcaggttggataatcaaattccaatgaaggtcctggagatattgtctaaattctgcaagaacaaggtaaggaatgttaatgaaatctaaatcttcataccttgaaatgtcccagctgtaactccagaagaacttgcacaaaattttcatacctcgtaatgcaagattaacctaacagtcaacgttgtatgaaatgatacattatgcaaggaggatactcgcacaaaatttgctatccattgaagatatcattcccatgagatttttttgcaaataaatgagtaatgtgcatgctcaagaaagcagtcaccatattgaaatcatgcagaagacactatttgcatatacatcatatatgctctattgaactaagacctggataaataacttctggatagataaactttattgaaatcctgcagaagacactatttgctgttaagtgttgaactttgtgtatggatccctttataaagctatcgtaatttatgctgttgcttaaagcaaataacttttttctgtcttccagatccaaagcattcatcagctgatcagacatttcttcttccgcaaatatgaagagggaagatatgatattagccaaacctctacgatatttcacctacccgagataacagggcatcacctactggatgtgtacaaaaaaactcttatacagcatggaggttatcatcacaccagcagtcgccaaccactatcggcagttgaactacaggaggcgggcgtaattttccagtgcagtgaaacgctgtcattgacagatatatgcttcaccaaaggtgtcctttgcctacctgcagtcgacgttgacgaagcatttgaagttgttatgcggaatctcattgcctatgagcaagcacatggcgaaggtcaagaggtaacatcctatgtgttttttatggatggcattgtaaacaatgacaaagatattgccttgcttcgagagaagggtattatcaggtcgggggtaagcagtgataagaggatagccgatctttttaatggactgacaaaaggtatagttgcaaaagttgtcgacaatgttgatgttgatgtaaccaaggacatcaatgagtattgcaatagaagatggaacaggtggcaagccaactttaagcagagatactttgcgaatccatgggtaacttgctcactcattgtaggagctctagtattaggtctcaccatcactcaaacaatctatggcatcctttcttataataagtgtagttaatgtaactctcatactcgaaaatgtatggatgattccagtcttgatcccagtcttttgtcatggctgtgtggctgtaagcattgtaatttgagacaatgacaaggatgaataggctaatatcaactgaaaaagcttcatattttttttggtttttgctcaagattgaataaaaatggctttaaaaaggtaatgtgtaacaatgtctcagattttattctttccacaccctgaactcaacttggttgcttctgtgcccaagtcaaatattaataaaaccatgtgcctttcttgcaagatcttggattttgttcgggtgccatttaataagagaagcttgaaggcatccctttgcattacccaaatggaatctgggagctatgttttaattacatttaaatagtggctctttgagggtgtttgtctttcaaatgttcagttccatgtcttacttccagttataattttttctagtgtagtgatactcttagtttctgctcatgatttaatgcatagtatctggcaaccaataaatgcaaatgcattagtgtcgatcacataacaagaaatgattagttcttcgagccaatttaattttctctgttattccttgatttccaaaactttgttattgttttgtcttatctgatctcagtctttctttgcaggcctttcccgggattcataaatgttgatctcaacggtagggtttcgtgctggggtttgagtatctgtggagcatttagtgtgagaaaactgtgcttaatttcgcttctccactatgagagtggaggagcacaactaatggtatccagtgtaaatttaactctttgtttgtggcttgagaacaacatgttctttatatagcctttgacaatgtaatagataacatcaacttctttgatacatactagcgatattagcatcctatctttttcttcttcatgttaacaatcctatagcctttacacgggtaatatatccttgtgatgtttaatcctaagtttttctctggtcagtgaatatgaacagcagctattattttattgcttgttc

SEQ ID NO: 142 - DNA, 1935 bp, Asparagus officinalis
atgtctgaagcctgggtttctcgattgacatcggatatagggtggctcaatagcacaaatgccctgatggcggaggcctggagtcgtcattcaatctacgacgtaccagacacattcaaaaggattagcccacagatccataagccatcaacgtgcagcattggaccacggtacaatggagatctgaatctccttcgtatggaacgtcataaacacagggcgctactgaacttcctcatccgatgtcaagtgtcgatccatgacatcatacgagccctgaggaagaacctgcacgatttcagagcctgctatcaagatcttgacaccttttggatgaagaatgatgatgagttcctaaaaatcatgatttacgatggggctttcatgattgaaatcatgatagcgaccgttgaaccatatgagcgcacaccttctagctatcatgccaaggacccaatattcaagaagccatacttggtcgaagatcttcgtgtagatatgctcaggttggataatcaaattccaatgaaggtcctggagatattgtctaaattctgcaagaacaaggtaaggaatgttaatgaaatctaaatcttcataccttgaaatgtcccagctgtaactccagaagaacttgcacaaaattttcatacctcgtaatgcaagattaacctaacagtcaacgttgtatgaaatgatacattatgcaaggaggatactcgcacaaaatttgctatccattgaagatatcattcccatgagatttttttgcaaataaatgagtaatgtgcatgctcaagaaagcagtcaccatattgaaatcatgcagaagacactatttgcatatacatcatatatgctctattgaactaagacctgaataaataacttctggatagataaactttattgaaatcctgcagaagacactatttgctgttaagtgttgaactttgtgtatggatccctttataaagctatcgtaatttatgctgttgcttaaagcaaataacttttttctgtcttccagatccaaagcattcatcagctgatcagacatttcttcttccgcaaatatgaagagggaagatatgatattagccaaacctctacgatatttcacctacccgagataacagggcatcacctactggatgtgtacaaaaaaactcttatacagcatggaggttatcatcacaccagtagtcgccaaccactatcggcagttgaactacaggaggcgggcgtaattttccagtgcagtgaaacgctgtcattgacagatatatgcttcaccaaaggtgtcctttgcctacctgcagtcgacgttgacgaagcatttgaagttgttatgcggaatctcattgcctatgagcaagcacatggcgaaggtcaagaggtaacatcctatgtgttttttatggatggcattgtaaacaatgacaaagatattgccttgcttcgagagaagggtattatcaggtcgggggtaagcagtgataagaggatagccgatctttttaatggactgacaaaaggtatagttgcaaaagttgtcgacaatgttgatgttgatgtaaccaaggacatcaatgagtattgcaatagaagatggaacaggtggcaagccaactttaagcagagatactttgcgaatccatgggtaacttgctcactcattgtaggagctctagtattaggtctcaccatcactcaaacaatctatggcatcctttcttataataagtgtagttaatgtaactctcatactcgaaaatgtatggatgattccagtcttgatcccagtcttttgtcatggctgtgtggctgtaagcattgtaatttgagacaatgacaaggatgaataggctaatatcaactgaaaaagcttcatattttttttggtttttgctcaagattgaataaaaatggctt

SEQ ID NO: 143 - DNA, 1932 bp, Asparagus officinalis
atgtctgaagcctgggtttctcgattgacatcggatatagggtggctcaatagcacaaatgccctgatggcggaggcctggagtcgtcattcaatctacgacgtaccagacacattcaaaaggattagcccacagatccataagccatcaacgtgcagcattggaccacggtacaatggagatctgaatctccttcgtatggaacgtcataaacacagggcgctactgaacttcctcatccgatgtcaagtgtcgatccatgacatcatacgagccctgaggaagaacctgcacgatttcagagcctgctatcaagatcttgacaccttttggatgaagaatgatgatgagttcctaaaaatcatgatttacgatggggctttcatgattgaaatcatgatagcgaccgttgaaccatatgagcgcacaccttctagctatcatgccaaggacccaatattcaagaagccatacttggtcgaagatcttcgtgtagatatgctcaggttggataatcaaattccaatgaaggtcctggagatattgtctaaattctgcaagaacaaggtaaggaatgttaatgaaatctaaatcttcataccttgaaatgtcccagctgtaactccagaagaacttgcacaaaattttcatacctcgtaatgcaagattaacctaacagtcaacgttgtatgaaatgatacattatgcaaggaggatactcgcacaaaatttgctatccattgaagatatcattcccatgagatttttttgcaaataaatgagtaatgtgcatgctcaagaaagcagtcaccatattgaaatcatgcagaagacactatttgcatatacatcatatatgctctattgaactaagacctggataaataacttctggatagataaactttattgaaatcctgcagaagacactatttgctgttaagtgttgaactttgtgtatggatccctttataaagctatcgtaatttatgctgttgcttaaagcaaataacttttttctgtcttccagatccaaagcattcatcagctgatcagacatttcttcttccgcaaatatgaagagggaagatatgatattagccaaacctctacgatatttcacctacccgagataacagggcatcacctactggatgtgtacaaaaaaactcttatacagcatggaggttatcatcacaccagcagtcgccaaccactatcggcagttgaactacaggaggcgggcgtaattttccagtgcagtgaaacgctgtcattgacagatatatgcttcaccaaaggtgtcctttgcctacctgcagtcgacgttgacgaagcatttgaagttgttatgcggaatctcattgcctatgagcaagcacatggcgaaggtcaagaggtaacatcctatgtgttttttatggatggcattgtaaacaatgacaaagatattgccttgcttcgagagaagggtattatcaggtcgggggtaagcagtgataagaggatagccgatctttttaatggactgacaaaaggtatagttgcaaaagttgtcgacaatgttgatgttgatgtaaccaaggacatcaatgagtattgcaatagaagatggaacaggtggcaagccaactttaagcagagatactttgcgaatccatgggtaacttgctcactcattgtaggagctctagtattaggtctcaccatcactcaaacaatctatggcatcctttcttataataagtgtagttaatgtaactctcatactcgaaaatgtatggatgattccagtcttgatcccagtcttttgtcatggctgtgtggctgtaagcattgtaatttgagacaatgacaaggatgaataggctaatatcaactgaaaaagcttcatattttttttggtttttgctcaagattgaataaaaatgg

SEQ ID NO: 144 - DNA, 1955 bp, Asparagus officinalis
atgtctgaagcctgggtttctcgattgacatcggatatagggtggctcaatagcacaaatgccctgatggcggaggcctggagtcgtcattcaatctacgacgtaccagacacattcaaaaggattagcccacagatccataagccatcaacgtgcagcattggaccacggtacaatggagatctgaatctccttcgtatggaacgtcataaacacagggcgctactgaacttcctcatccgatgtcaagtgtcgatccatgacatcatacgagccctgaggaagaacctgcacgatttcagagcctgctatcaagatcttgacaccttttggatgaagaatgatgatgagttcctaaaaatcatgatttacgatggggctttcatgattgaaatcatgatagcgaccgttgaaccatatgagcgcacaccttctagctatcatgccaaggacccaatattcaagaagccatacttggtcgaagatcttcgtgtagatatgctcaggttggataatcaaattccaatgaaggtcctggagatattgtctaaattctgcaagaacaaggtaaggaatgttaatgaaatctaaatcttcataccttgaaatgtcccagctgtaactccagaagaacttgcacaaaattttcatacctcgtaatgcaagattaacctaacagtcaacgttgtatgaaatgatacattatgcaaggaggatactcgcacaaaatttgctatccattgaagatatcattcccatgagatttttttgcaaataaatgagtaatgtgcatgctcaagaaagcagtcaccatattgaaatcatgcagaagacactatttgcatatacatcatatatgctctattgaactaagacctggataaataacttctggatagataaactttattgaaatcctgcagaagacactatttgctgttaagtgttgaactttgtgtatggatccctttataaagctatcgtaatttatgctgttgcttaaagcaaataactttttttctgtcttccagatccaaagcattcatcagctgatcagacatttcttcttccgcaaatatgaagagggaagatatgatattagccaaacctctacgatatttcacctacccgagataacagggcatcacctactggatgtgtacaaaaaaactcttatacagcatggaggttatcatcacaccagcagtcgccaaccactatcggcagttgaactacaggaggcgggcgtaattttccagtgcagtgaaacgctgtcattgacagatatatgcttcaccaaaggtgtcctttgcctacctgcagtcgacgttgacgaagcatttgaagttgttatgcggaatctcattgcctatgagcaagcacatggcgaaggtcaagaggtaacatcctatgtgttttttatggatggcattgtaaacaatgacaaagatattgccttgcttcgagagaagggtattatcaggtcgggggtaagcagtgataagaggatagccgatctttttaatggactgacaaaaggtatagttgcaaaagttgtcgacaatgttgatgttgatgtaaccaaggacatcaatgagtattgcaatagaagatggaacaggtggcaagccaactttaagcagagatactttgcgaatccatgggtaacttgctcactcattgtaggagctctagtattaggtctcaccatcactcaaacaatctatggcatcctttcttataataagtgtagttaatgtaactctcatactcgaaaatgtatggatgattccagtcttgatcccagtcttttgtcatggctgtgtggctgtaagcattgtaatttgagacaatgacaaggatgaataggctaatatcaactgaaaaagcttcatattttttttggtttttgctcaagattgaataaaaatggctttaaaaaggtaatgtgtaac

SEQ ID NO: 145 - DNA, 2795 bp, Asparagus officinalis
atgtctgaagcctgggtttctcgattgacatcggatatagggtggctcaatagcacaaatgccctgatggcggaggcctggagtcgtcattcaatctacgacgtaccagacacattcaaaaggattagcccacagatccataagccatcaacgtgcagcattggaccacggtacaatggagatctgaatctccttcgtatggaacgtcataaacacagggcgctactgaacttcctcatccgatgtcaagtgtcgatccatgacatcatacgagccctgaggaagaacctgcacgatttcagagcctgctatcaagatcttgacaccttttggatgaagaatgatgatgagttcctaaaaatcatgatttacgatggggctttcatgattgaaatcatgatagcgaccgttgaaccatatgagcgcacaccttctagctatcatgccaaggacccaatattcaagaagccatacttggtcgaagatcttcgtgtagatatgctcaggttggataatcaaattccaatgaaggtcctggagatattgtctaaattctgcaagaacaaggtaaggaatgttaatgaaatctaaatcttcataccttgaaatgtcccagctgtaactccagaagaacttgcacaaaattttcatacctcgtaatgcaagattaacctaacagtcaacgttgtatgaaatgatacattatgcaaggaggatactcgcacaaaatttgctatccattgaagatatcattcccatgagatttttttgcaaataaatgagtaatgtgcatgctcaagaaagcagtcaccatattgaaatcatgcagaagacactatttgcatatacatcatatatgctctattgaactaagacctggataaataacttctggatagataaactttattgaaatcctgcagaagacactatttgctgttaagtgttgaactttgtgtatggatccctttataaagctatcgtaatttatgctgttgcttaaagcaaataacttttttctgtcttccagatccaaagcattcatcagctgatcagacatttcttcttccgcaaatatgaagagggaagatatgatattagccaaacctctacgatatttcacctacccgagataacagggcatcacctactggatgtgtacaaaaaaactcttatacagcatggaggttatcatcacaccagcagtcgccaaccactatcggcagttgaactacaggaggcgggcgtaattttccagtgcagtgaaacgctgtcattgacagatatatgcttcaccaaaggtgtcctttgcctacctgcagtcgacgttgacgaagcatttgaagttgttatgcggaatctcattgcctatgagcaagcacatggcgaaggtcaagaggtaacatcctatgtgttttttatggatggcattgtaaacaatgacaaagatattgccttgcttcgagagaagggtattatcaggtcgggggtaagcagtgataagaggatagccgatctttttaatggactgacaaaaggtatagttgcaaaagttgtcgacaatgttgatgttgatgtaaccaaggacatcaatgagtattgcaatagaagatggaacaggtggcaagccaactttaagcagagatactttgcgaatccatgggtaacttgctcactcattgtaggagctctagtattaggtctcaccatcactcaaacaatctatggcatcctttcttataataagtgtagttaatgtaactctcatactcgaaaatgtatggatgattccagtcttgatcccagtcttttgtcatggctgtgtggctgtaagcattgtaatttgagacaatgacaaggatgaataggctaatatcaactgaaaaagcttcatattttttttggtttttgctcaagattgaataaaaatggctttaaaaaggtaatgtgtaacaatgtctcagattttattctttccacaccctgaactcaacttggttgcttctgtgcccaagtcaaatattaataaaaccatgtgcctttcttgcaagatcttggattttgttcgggtgccatttaataagagaagcttgaaggcatccctttgcattacccaaatggaatctgggagctatgttttaattacatttaaatagtggctctttgagggtgtttgtctttcaaatgttcagttccatgtcttacttccagttataattttttctagtgtagtgatactcttagtttctgttcatgatttaatgcatagtatctggcaaccaataaatgcaaatgcattagtgtcgatcacataacaagaaatgattagttcttcgagccaatttaattttctctgttattccttgatttccaaaactttgttattgttttgtcttatctgatctcagtctttctttgcaggcctttcccgggattcataaatgttgatctcaacggtagggtttcgtgctggggtttgagtatctgtggagcatttagtgtgagaaaactgtgcttaatttcgcttctccactatgagagtggaggagcacaactaatggtatccagtgtaaatttaactctttgtttgtggcttgagaacaacatgttctttatatagcctttgacaatgtaatagataacatcaacttctttgatacatactagcgatattagcatcctatctttttcttcttcatgttaacaatcctatagcctttacacgggtaatatatccttgtgatgtttaatcctaagtttttctctggtcagtgaatatgaacagcagctattat

SEQ ID NO: 146 - DNA, 2803 bp, Asparagus officinalis
atgtctgaagcctgggtttctcgattgacatcggatatagggtggctcaatagcacaaatgccctgatggcggaggcctggagtcgtcattcaatctacgacgtaccagacacattcaaaaggattagcccacagatccataagccatcaacgtgcagcattggaccacggtacaatggagatctgaatctccttcgtatggaacgtcataaacacagggcgctactgaacttcctcatccgatgtcaagtgtcgatccatgacatcatacgagccctgaggaagaacctgcacgatttcagagcctgctatcaagatcttgacaccttttggatgaagaatgatgatgagttcctaaaaatcatgatttacgatggggctttcatgattgaaatcatgatagcgaccgttgaaccatatgagcgcacaccttctagctatcatgccaaggacccaatattcaagaagccatacttggtcgaagatcttcgtgtagatatgctcaggttggataatcaaattccaagaaggtcctggagatattgtctaaattctgcaagaacaaggtaaggaatgttaatgaaatctaaatcttcataccttgaaatgtcccagctgtaactccagaagaacttgcacaaaattttcatacctcgtaatgcaagattaacctaacagtcaacgttgtatgaaatgatacattatgcaaggaggatactcgcacaaaatttgctatccattgaagatatcattcccatgagatttttttgcaaataaatgagtaatgtgcatgctcaagaaagcagtcaccatattgaaatcatgcagaagacactatttgcatatacatcatatatgctctattgaactaagacctggataaataacttctggatagataaactttattgaaatcctgcagaagacactatttgctgttaagtgttgaactttgtgtatggatccctttataaagctatcgtaatttatgctgttgcttaaagcaaataactttttttctgtcttccagatccaaagcattcatcagctgatcagacatttcttcttccgcaaatatgaagagggaagatatgatattagccaaacctctacgatatttcacctacccgagataacagggcatcacctactggatgtgtacaaaaaaactcttatacagcatggaggttatcatcacaccagcagtcgccaaccactatcggcagttgaactacaggaggcgggcgtaattttccagtgcagtgaaacgctgtcattgacagatatatgcttcaccaaaggtgtcctttgcctacctgcagtcgacgttgacgaagcatttgaagttgttatgcggaatctcattgcctatgagcaagcacatggcgaaggtcaagaggtaacatcctatgtgttttttatggatggcattgtaaacaatgacaaagatattgccttgcttcgagagaagggtattatcaggtcgggggtaagcagtgataagaggatagccgatctttttaatggactgacaaaaggtatagttgcaaaagttgtcgacaatgttgatgttgatgtaaccaaggacatcaatgagtattgcaatagaagatggaacaggtggcaagccaactttaagcagagatactttgcgaatccatgggtaacttgctcactcattgtaggagctctagtattaggtctcaccatcactcaaacaatctatggcatcctttcttataataagtgtagttaatgtaactctcatactcgaaaatgtatggatgattccagtcttgatcccagtcttttgtcatggctgtgtggctgtaagcattgtaatttgagacaatgacaaggatgaataggctaatatcaactgaaaaagcttcatattttttttggtttttgctcaagattgaataaaaatggctttaaaaaggtaatgtgtaacaatgtctcagattttattctttccacaccctgaactcaacttggttgcttctgtgcccaagtcaaatattaataaaaccatgtgcctttcttgcaagatcttggattttgttcgggtgccatttaataagagaagcttgaaggcatccctttgcattacccaaatggaatctgggagctatgttttaattacatttaaatagtggctctttgagggtgtttgtctttcaaatgttcagttccatgtcttacttccagttataattttttctagtgtagtgatactcttagtttctgttcatgatttaatgcatagtatctggcaaccaataaatgcaaatgcattagtgtcgatcacataacaagaaatgattagttcttcgagccaatttaattttctctgttattccttgatttccaaaactttgttattgttttgtcttatctgatctcagtctttctttgcaggcctttcccgggattcataaatgttgatctcaacggtagggtttcgtgctggggtttgagtatctgtggagcatttagtgtgagaaaactgtgcttaatttcgcttctccactatgagagtggaggagcacaactaatggtatccagtgtaaatttaactctttgtttgtggcttgagaacaacatgttctttatatagcctttgacaatgtaatagataacatcaacttctttgatacatactagcgatattagcatcctatctttttcttcttcatgttaacaatcctatagcctttacacgggtaatatatccttgtgatgtttaatcctaagtttttctctggtcagtgaatatgaacagcagctattattttattgc

SEQ ID NO: 147 - DNA, 618 bp, Asparagus officinalis
tgcagcattggaccacggtacaatggagatctgaatctccttcgtatggacgtcataaacacagggcgctactgaacttcctcatccgatgtcaagtgtcgatccatgacatcatacgagccctgaggaagaacctgcacgatttcagagcctgctatcaagatcttgacaccttttggatgaagaatgatgatgagttcctaaaaatcatgatttacgatggggctttcatgattgaaatcatgatagcgaccgttgaaccatatgagcgcacaccttctagctatcatgccaaggacccaatattcaagaagccatacttggtcgaagatcttcgtgtagatatgctcaggttggataatcaaattccaatgaaggtcctggagatattgtctaaattctgcaagaacaaggtaaggaatgttaatgaaatctaaatcttcataccttgaaatgtcccagctgtaactccagaagaacttgcacaaaattttccttattccttattccttattccttgcagttatatacgttatagcggatcccatccatcggctccaaagcttcggccagctgtcgagcaagacgttgacgctgtctttgtcrtgctctctttgt

SEQ ID NO: 148 - DNA, 2295 bp, Asparagus officinalis
atgggcaggcctccatgctgcgataaatccaacgtgaagaagggactttggactgaggaagaagatttgaagctaatagcttataccaacactcatggaataggaaattggacttctgttccaaagaaagcaggttctttttacgtagctaattggttgattttcttcaaaataatatttacgttattgattttttatttatttattggtaatgtgagtatgcaattttagggttgaagagatgtgggaagagctgtaggctaagatggactaattatctgcgccctaatttgaagcatgagagcttcactcaacaagaagaggagatgattataacacttcatgctacaatcggaagccggtattgttctctctatcaatttatttgattgaggattttatatcatgatgttaactactgtagttttcattttagtcaattaggaacattattttgtttgaatagttttaacctagaaagaatttctagtgtagagctgctaacacaaatatctttacactgtccagatattaaagcggggctgaaatagtaaaaaggaggaggaggaaaatatctataactatatatgacaaccccagtttgaaattgattttaaacataattttatctagaagtgagatggacaggcatcaaaaacctgtacttttgaaatgtagaatgtaaattaactcaacaataggatatttatacatttgaaattttcatatttgaaatcttctatgttgagttaatctatgattatcatctggggtccacagaaattgaaaacatttggttttggaacagaattctagtttcaaatgacagaaagatcttttataatctcaaaatgatgagtagttctattaattagtttttgcttactatttcagaagtttaccaaaagaccagtttgttttgttgaatttacatcaagatgagtagattgtctcttttgccagtttccctactcattttatcattcactaatgagtaatgagtagctaaattgtttaatattgcacaataggtataaactgctaatttcatgggtaaattacactaaacccccataaactttcagtgctttgtagtaaacacagtaaactttcaaaatcacactaaaatcccaataacttttgcagagaacttctatgaacttctatggtaaattatactaaaccctcatgaactttcaaaatacctttttatgttatttttttgttctaattttggggattatctacaaaactcagaaaaatcatgggcgctctttgcaattccaaaaagttcattggggtttagtgttattttgaaaattcattgggatatattgcaaaactctaaaagttcaagggtttattgtaatttaccctaatttaatattgcacattattgtccccttttgaatgaaatgggctaattaaggcttatatttcctttcgttatcatgagatttgaaagaactattggtgtaaaggaagctacggtagctaaaagtttggattagttaaagagtcatctaattaccttagaattaaagctaccggcatatttcaatttcgtgattggaggcagtatgaaagtgatgatccctatctcctaacaaatttaactaaccatgacgtacacacgatcactccccctcactctctccaacagtcacaattatattcctttttagtacttaattatgtacataacaccatgattatttttagtacaggtggtcggtaatcgcacatcacctcccgggtcgaacagacaacgacataaagaaccactggaacacaaaactgagcaaaaaactgtgccagcaaggcatcgaccccgtcacccacaaacccatctctcaaatcaaggaaaccatcaccactctagccgccgccgccgccgccaaccaccacctcctaatccaccctccacccttcaacacccgcgtcaacagctgcctgagccgcgacctcaagaacgtcctcctctccaaaccgcaacaattctacgaaccaacaacagccacaagcaccacattggatgaggtttataagcaggataaggagatcaaatggagcgattatctcgtcgacgatgttttcgtgccgaaccaagagaaggaattggtggtgaatggatatgggaaggagaaggtgacaagtgcagtggatgaggaggtgagtagtactgtgtttggaggtgaagggagtagtagctcgagttcttttgtggagggaatattagatcaggggagggagatgatgatggagttccctgagtttttttatgatttgctgtag

SEQ ID NO: 149 - protein, 276 aa, Asparagus officinalis; identical to SEQ ID NO: 5

SEQ ID NO: 150 - protein, 45 aa, Artificial Sequence
  Blast query
AGLNRCGKSCRLRWTNYLRPDLKHDSFSTQEEELIIECHRAIGSR

SEQ ID NO: 151 - protein, 47 aa, Artificial Sequence
  blast query
RWSSIARKLPGRTDNDVKNHWNTKLKKKLMKMGIDPVTHKPVSQLLA

SEQ ID NO: 152 - protein, 45 aa, Artificial Sequence
  blast query
MGRPPCCDKSNVKKGLWTEEEDAKILAYVAIHGVGNWSLIPKKAG

SEQ ID NO: 153 - protein, 48 aa, Artificial Sequence
  blast query
GLNRCGKSCRLRWTNYLRPDLKHDSFSTQEEELIIECHRAIGSRWSSI

SEQ ID NO: 154 - protein, 45 aa, Artificial Sequence
  blast query
RWSSIARKLPGRTDNDVKNHWNTKLKKKLMKMGIDPVTHKPVSQL

SEQ ID NO: 155 - protein, 10 aa, Artificial Sequence
  (partial) result of blast query
RCGKSCRLRW

SEQ ID NO: 156 - protein, 8 aa, Artificial Sequence
  (partial) result of blast query
NYLRPDLK

SEQ ID NO: 157 - protein, 45 aa, Artificial Sequence
  (partial) result of blast query
SGLQRCGKSCRLRWINYLRPDLKRGTFSQQEENLIIDLHAVLGNR

SEQ ID NO: 158 - protein, 7 aa, Artificial Sequence
  (partial) result of blast query
LPGRTDN

SEQ ID NO: 159 - protein, 4 aa, Artificial Sequence
  (partial) result of blast query
KKKL

SEQ ID NO: 160 - protein, 4 aa, Artificial Sequence
  (partial) result of blast query
GIDP

SEQ ID NO: 161 - protein, 4 aa, Artificial Sequence
  (partial) result of blast query
THKP

SEQ ID NO: 162 - protein, 47 aa, Artificial Sequence
  (partial) result of blast query
RWSQIAAQLPGRTDNEIKNLWNSCIKKKLRQRGIDPNTHKPLSETEA

SEQ ID NO: 163 - protein, 4 aa, Artificial Sequence
  (partial) result of blast query
KGLW

SEQ ID NO: 164 - protein, 45 aa, Artificial Sequence
  (partial) result of blast query
MGRHSCCYKQKLRKGLWSPEEDEKLLKHITKYGHGCWSSVPKQAG

SEQ ID NO: 165 - protein, 22 aa, Artificial Sequence
  (partial) result of blast query
MGRPPCCDKSNVKKGLWTEEED

SEQ ID NO: 166 - protein, 5 aa, Artificial Sequence
  (partial) result of blast query
PKKAG

SEQ ID NO: 167 - protein, 45 aa, Artificial Sequence
  (partial) result of blast query
MGRPPCCDKSNVKKGLWTEEEDLKLIAYTNTHGIGNWTSVPKKAG

SEQ ID NO: 168 - protein, 16 aa, Artificial Sequence
  (partial) result of blast query
RCGKSCRLRWTNYLRP

SEQ ID NO: 169 - protein, 4 aa, Artificial Sequence
  (partial) result of blast query
QEEE

SEQ ID NO: 170 - protein, 4 aa, Artificial Sequence
  (partial) result of blast query
IGSR

SEQ ID NO: 171 - protein, 48 aa, Artificial Sequence
  (partial) result of blast query
GLKRCGKSCRLRWTNYLRPNLKHESFTQQEEEMIITLHATIGSRYCSL

SEQ ID NO: 172 - protein, 8 aa, Artificial Sequence
  (partial) result of blast query
LPGRTDND

SEQ ID NO: 173 - protein, 8 aa, Artificial Sequence
  (partial) result of blast query
KNHWNTKL

SEQ ID NO: 174 - protein, 9 aa, Artificial Sequence
  (partial) result of blast query
GIDPVTHKP

SEQ ID NO: 175 - protein, 45 aa, Artificial Sequence
  (partial) result of blast query
RWSVIAHHLPGRTDNDIKNHWNTKLSKKLCQQGIDPVTHKPISQI

The invention claimed is:

1. An *Asparagus* plant in which functional expression of a DUF247 domain-containing protein with SEQ ID NO:2, encoded by a dominant Gynoecium Development Suppressor (GDS) gene having SEQ ID NO:3, or having at least 95% sequence identity to SEQ ID NO:3 is reduced, wherein the functional expression is reduced by disruption of the GDS gene having SEQ ID NO:3 or having at least 95% sequence identity thereto.

2. The *Asparagus* plant of claim 1, wherein said plant is the result of a treatment with gamma irradiation.

3. The *Asparagus* plant of claim 1, wherein the GDS gene is disrupted by deletion of the coding information after a nucleotide corresponding to nucleotide 567 of SEQ ID NO:1.

4. The *Asparagus* plant of claim 1, wherein the GDS gene is disrupted by a deletion of a nucleotide corresponding to thymine at position 527 of SEQ ID NO:1.

5. The *Asparagus* plant of claim 1, wherein the GDS gene is disrupted by an adenine to guanine mutation at a position that corresponds to position 1193 in SEQ ID NO:1, resulting in an exchange of an asparagine (N) to serine (S) at a position corresponding to position 398 of SEQ ID NO:2.

6. The *Asparagus* plant of claim 1, wherein the GDS gene is disrupted by an adenine to thymine change at a position corresponding to position 1160 of SEQ ID NO:3, which is 665 nucleotides upstream the first start codon of the GDS gene.

7. The *Asparagus* plant of claim 1, wherein the GDS gene is disrupted by deletion of the entire GDS gene corresponding to SEQ ID NO:3.

8. The *Asparagus* plant of claim 1, which has a defective Tapetal Development and Function 1 (TDF1) gene having SEQ ID NO:6, or having at least 95% sequence identity to SEQ ID NO:6, or a deletion of the TDF gene.

9. The *Asparagus* plant of claim 1, which expresses an *Asparagus officinalis* Tapetal Development and Function 1 (TDF1) protein as depicted in SEQ ID NO:5.

10. The *Asparagus* plant of claim 1, which is an *Asparagus officinalis* plane.

* * * * *